United States Patent 12,397,048 (BUNYAVIRALES VACCINE) - sequence listing, part 4

SEQ ID NO: 4425 - RNA, 3480 nt, synthetic construct
  misc_feature 1..3480: note = derived and/or modified CDS sequence (wt) from RVFV(CAR-R1622)__DQ380219.1__NSm-Gn-Gc
  source 1..3480: mol_type = other RNA
atgattgaaggagcttgggattcactcagagaggaggagatgccagaggagctctcctgttctatatcaggcataagggaggttaagacctcaagccaggagttatacagggcattaaaagccatcattgctgctgatggcttgaacaacatcacctgccatggtaaggatcctgaggacaagatttctctcataaagggtcctcctcataaaaagcgggtggggatagttcggtgtgagagacgaagagatgctaagcaaatagggagagaaaccatggcagggattgcaatgacagtccttccagccttagcagtttttgctttggcacctgttgtttttgctgaggacccccatctcagaaacagaccagggaaggggcacaactacattgacgggatgacccaggaggatgccacatgcaaacctgtgacatatgctggggcatgtagcagttttgatgtcttgcttgagaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctaaagaaggggtcttatcctctccaagacttattttgccagtcaagtgaggatgatggatcaaaattaaaaacaaaaatgaaaggggtctgcgaagtgggggtccaagcactcaaaaagtgtgatggccaactcagcaccgcacatgaggttgtgccctttgcagtgtttaagaactcaaagaaggtttacctcgataagcttgacctcaagactgaggagaatctgctgccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtgtcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgttacaggatcacagagtccttctaccgagattacactcaagtatccagggatatcccagtcctcagggggggacataggggttcacatggcacacgatgatcagtcagttagctccaaaatagtagctcactgccctccccaggacccatgcttagtgcacggctgcatagtgtgtgctcatggcctgataaattaccagtgtcacactgctctcagtgcctttgttgttgtgtttgtattcagttctattgcaataatttgtttagccattctttatagggtgctcaagtgcttaaagattgccccaaggaaagttctgaatccactaatgtggatcacagccttcatcagatgggtgtataagaagatggttgccagagtggcagacaatattaatcaagtgaacagggagataggatggatggaaggaggtcagttggttctagggaaccctgcccctattcctcgtcatgccccaatcccacgttatagcacatacctaatgctactgctaattgtctcatatgcatcagcatgttcagaactaattcaggcaagctccagaatcactacttgctccacagagggtgtcaacaccaagtgtagactgtctggtacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagtacaaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagccaatgatagatcaattggagtgcacaacaaatctgattgatccctttgttgtatttgagaggggttctctgccacagacaaggaatgacaaaacctttgcagcttcaaaaggaaatagaggtgttcaagctttctctaagggctctgtgcaagctgatctaactctgatgtttgacaattttgaggtggactttgtgggagcagctgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgccagatactacacttcactgtacctgaagtagaggaggagtttatgtactcttgtgatggagatgagcggcctctattagtgaaagggaccctgatagctattgatccatttgatgataggcgggaagcagggggagaatcaacagttgtgaatccaaaatctggatcttggaatttctttgactggttttctggactcatgagttggtttggagggcctctcaaaactatactcctcatttgcctgtatgttgcattatcaattgggctctttttcctcctcatatatcttggaagaacagggctctctaaaatgtggcttgctgctactaagaaggcctcatag

SEQ ID NO: 4426 - RNA, 3480 nt, synthetic construct
  misc_feature 1..3480: note = derived and/or modified CDS sequence (wt) from RVFV(2250/74)__DQ380209.1__NSm-Gn-Gc
  source 1..3480: mol_type = other RNA
atgattgaaggagcttgggattcactcagagaggaggagatgccggaggagctctcctgttctatatcaggcataagagaggttaagacctcaagccaggagttatacagggcattaaaagccatcattgctgccgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaagtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtaggatatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaatattaatcaagtgaacagggaaataggatggatggaaggaggtcagttggttctagggaaccctgcccctattcctcgtcatgccccaatcccacgttatagcacatacctgatgttactattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcagtgtggaggatgggggtgtgggtgttttaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagagattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccaaggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4427 - RNA, 3480 nt, synthetic construct
  misc_feature 1..3480: note = derived and/or modified CDS sequence (wt) from RVFV(2007000094)__EU574055.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgagtggggatagtccggtgtgagagacgaagagatgctaagcaaatagggagagaaaccatggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctgctagaggcagttcatgacaccatcattgcaaaggctgatccacctagctgtgacctccagagtgctcatgggaatccctgtatgaaagagaaacttgtgatgaagacacattgtcctaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagcatgttcagaactgattcaggcaagctccagaatcaccacttgctccacagagggtgtcaacaccaagtgtagactgtctggcacagcattgatcagggcagggtcagttggggcggaagcttgtttgatgttgaagggggtcaaggaagatcaaaccaagttcttaaagataaaaactgtctcaagtgagctatcgtgcagggagggccagagctattggactgggtcctttagccccaagtgcctgagctcaagaagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctcatag

SEQ ID NO: 4428 - RNA, 3480 nt, synthetic construct
  misc_feature 1..3480: note = derived and/or modified CDS sequence (wt) from RVFV(ZM-657)__DQ380204.1__NSm-Gn-Gc
  source 1..3480: mol_type = other RNA
atgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaaagcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagtcctaaatgtttgagctcaaggagatgccaccttgtcggggaatgccatgtgaataggtgtctgtcttggagggacaatgaaacttcagcagagttttcatttgttggggaaagcacaaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctcttttttctccttatatatcttggaagaacaggcctctctaaaatgtggcttgctgccactaagaaggcctcatag

SEQ ID NO: 4429 - RNA, 3480 nt, synthetic construct
  misc_feature 1..3480: note = derived and/or modified CDS sequence (wt) from RVFV(ZH-548M12)__M25276.1__NSm-Gn-Gc
  source 1..3480: mol_type = other RNA
atgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagaaaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcatcacctcaacaatgacgggaaaatggcttcagtcaagtgccctcctaagtatgagctcactgaagactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagttaaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaggaacaggcctctctaaaatgtggcttgctgccactaagaaggcctcatag

SEQ ID NO: 4430 - RNA, 3480 nt, synthetic construct
  misc_feature 1..3480: note = derived and/or modified CDS sequence (wt) from RVFV(ZH-501-777)__DQ380202.1__NSm-Gn-Gc
  source 1..3480: mol_type = other RNA
atgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggaccctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtaaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatctcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgataaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4431 - RNA, 3480 nt, synthetic construct
  misc_feature 1..3480: note = derived and/or modified CDS sequence (wt) from RVFV(T-46 (228113))__DQ380199.1__NSm-Gn-Gc
  source 1..3480: mol_type = other RNA
atgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaaaggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatctcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgataaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4432 - RNA, 3480 nt, synthetic construct
  misc_feature 1..3480: note = derived and/or modified CDS sequence (wt) from RVFV(OS-3)__DQ380184.1__NSm-Gn-Gc
  source 1..3480: mol_type = other RNA
atgattgagggagcttgggattcactcagagaggaggagatgccagaggagctctcctgctctatatcaggcataagggaggttaagacctcaagccaggaattatacagagcattaaaagccatcattgctgctgatggcttgaacaacatcacctgccatggtaaggatcctgaggacaagatttctcttataaagggtcctcctcacaaaaagcgggtggggatagttcggtgtgagagacgaagagacgctaagcaaatagggagagaaaccatggcagggattgcaatgacagtccttccagccttagcagtttttgctttggcacctgttgtatttgctgaagacccccatctcagaaatagaccagggaaggggcacaactacattgacgggatgactcaggaggatgccacttgtaaacctgtgacatatgctggggcatgtagcagttttgatgtcttgctcgaaaagggaaaattccccctcttccagtcgtatgctcatcatagaactctactagaggcagttcatgacaccatcattgcaaaggctgatccacctagttgtgatcttcagagtgctcatgggaatccttgcatgaaagagaaactcgtgatgaagacacactgtccaaatgactaccagtcagcccactacctcaacaatgatgggaaaatggcctcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaggcactcaagaagtgtgatggccagctcagcactgcacatgaggttgtgccctttgcagtgtttaagaactcaaagaaggtttatcttgacaagcttgacctcaaaactgaagaaaatctgctaccagactcatttgtctgcttcgagcataagggacagtataaaggaacaatggactctggtcaaactaagagggagctcaaaagctttgatatctctcagtgccccaagattggaggacatggtagcaagaagtgcactggggacgcagcattttgctctgcttatgagtgcactgctcaatacgccaatgcctattgttcacatgctaatgggtcaggagttgtgcagatacaagtatccggggtctggaagaaacctttatgtgtagggtatgagagagtggttgtgaagagagaactctctgccaaacccatccagagagttgagccttgcacaacctgtataaccaaatgtgagcctcatggattggttgtccgatcaacagggttcaagatatcatctgcagttgcatgtgctagcggagtttgtgtcacaggatcgcagagtccttctaccgagatcacactcaagtatccagggatatcccagtcctctgggggggacataggggttcacatggcacacgatgatcagtcagttagctccaaaatagtagctcactgccccccccaggacccgtgcctagtgcatggctgcatagtgtgtgctcatggcctaataaattaccagtgtcacactgctctcagtgcctttgttgttgtgttcgtattcagctctgttgcaataatttgtttggccattctttataaggtgctcaagtgcctaaagattgccccaaggaaagttctaaatccactaatgtggattactgccttcatcagatgggtgtataagaagatggttgccagggtggcagacaatattaatcaagtgaacagagaaataggatggatggagggaggtcagttggctctagggaaccctgcccctattcctcgtcatgccccaattccacgttatagcacatacctgatgctactattgattgtctcatatgcatcagcatgttcagaactgattcaggcaagctctagaataaccacttgctccacagaaggtgtcaacaccaagtgtaggctgtctggcacagcattaatcagggcagggtcagttggggcagaggcttgcttgatgttaaagggagtcaaggaggaccaaacaaagttcttgaagataaaaactgtctcaagtgagctatcgtgcagggaaggccagagctattggactggatcctttagtcccaaatgtctgagctcaaggagatgccatcttgtcggggaatgtcatgtgaataggtgtctgtcttggagggacaatgaaacttcagcagagttttcatttgttggggaaagcacgactatgcgagagaataaatgttttgagcagtgtgggggatggggatgtgggtgcttcaatgtgaacccatcttgcttgtttgtgcacacgtatctgcagtcagttagaaaagaggcccttagagtttttaactgtatcgattgggtgcataaactcactctagagatcacagactttgatggttctgtttcaacaatagacttgggagcatcatctagccgtttcacaaactggggctcagttagcctctcactggatgcagagggcatttcaggctcaaatagcttttctttcattgagagcccaggcaaagggtatgcaattgttgatgagccattctcagaaatccctcggcaagggttcttgggggagatcaggtgcaattcagaatcttcagtcctgagtgctcatgaatcatgccttcgggcaccaaacctcatctcatacaagcccatgatagaccagttggagtgcacaacaaatctgattgatccctttgttgtctttgagaggggttctctgcctcagacaaggaatgataaaacttttgcagcttcaaaaggaaataggggtgttcaagctttctctaagggctctgtacaagctgatttaactctgatgtttgacaattttgaggtggactttgtgggagcagccgtgtcttgtgatgccgctttcttaaatctgacaggttgttattcttgtaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatcgccattgatccatttgatgacaggcgggaagcagggggagaatcaacagttgtgaatccaaaatctggatcttggaatttctttgactggttttctggactcatgagttggtttggagggcctcttaagactatactcctcatttgcctgtatgttgcattatcaattgggctctttttccttctcatatatcttggaagaacaggtctctctaaaatgtggcttgctgctactaagaaggcctcataa

SEQ ID NO: 4433 - RNA, 3480 nt, synthetic construct
  misc_feature 1..3480: note = derived and/or modified CDS sequence (wt) from RVFV(Sudan 86-2010)__JQ820489.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgagtggggatagtccggtgtgagagacgaagagatgctaagcaaatagggagagaaaccatggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaaccctactagaggcagttcacgacaccatcattgcaaaggctgatccacctagctgtgacctccagagtgctcatgggaatccctgtatgaaagagaaacttgtgatgaagacacattgtccaaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcaaagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtactcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccctgcccctattcctcgtcatgccccaatcccacgttatagcacatacctaatgctactactgattgtctcatatgcatcagcatgttcagaactgattcaggcaagttccagaatcaccacttgctccacagagggtgtcaacaccaagtgtagactgtctggcacagcattgatcagggcagggtcagttggggcggaggcttgtttgatgttgaagggggtcaaggaagatcaaaccaagttcttaaagataaaaactgtctcaagtgagctatcgtgcagggagggccagagctattggactgggtccttcagccccaagtgcctgagctcaaggagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttatctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatctgacaggttgctattcttgcaatgcaggggccagagtttgcctgtctatcacatccacaggaactgggactctctctgcccacaataaggacgggtctctgcatatagttctcccatcagagaatgggacaaaagatcagtgtcagatactacatttcaccgtacctgaagtagaagaggagtttatgtactcttgtgatggagatgagcggcctctgttagtgaaagggaccctgatagctattgacccatttgatgataggcgggaggctgggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctcatag

SEQ ID NO: 4434 - RNA, 3480 nt, synthetic construct
  misc_feature 1..3480: note = derived and/or modified CDS sequence (wt) from RVFV(Sudan 28-2010)__JQ820491.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgagtggggatagtccggtgtgagagacgaagagatgctaagcaaatagggagagaaaccatggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgacctccagagtgctcatgggaatccctgtatgaaagagaaacttgtgatgaagacacattgtccaaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaaaactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggtagtgaagagagaactctcagccaaacccatccagagagttgagccttgcacaacttgcataaccaaatgtgagcctcatggattggttgtccgatcaacagggttcaagatatcgtctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagcatgttcagaactgattcaggcaagctccagaatcaccacttgctctacagagggtgtcaacaccaagtgtagactgtctggcacagcattgatcagggcagggtcagttggggcggaggcttgtttgatgttgaagggggtcaaggaagatcaaaccaagttcttaaagataaaaactgtttcaagtgagctatcgtgcagggagggccagagctattggactgggtcctttagccccaagtgcctgagctcaagaagatgccatcttgtcggagaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgtattatcaattgggctcttcttcctccttatatatcttggaagaacaggcctctctaaaatgtggcttgctgctactaagaaggcctcatag

SEQ ID NO: 4435 - RNA, 3480 nt, synthetic construct
  misc_feature 1..3480: note = derived and/or modified CDS sequence (wt) from RVFV(2007004194)__EU574031.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgagtggggatagtccggtgtgagagacgaagagatgctaagcaaatagggagagaaaccatggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctgctagaggcagttcatgacaccatcattgcaaaggctgatccacctagctgtgacctccagagtgctcatgggaatccctgtatgaaagagaaacttgtgatgaagacacattgtcctaacgactaccagtcagctcattacctcagcaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagcatgttcagaactgattcaggcaagctccagaatcaccacttgctccacagagggtgtcaacaccaagtgtagactgtctggcacagcattgatcagggcagggtcagttggggcggaagcttgtttgatgttgaagggggtcaaggaagatcaaaccaagttcttaaagataaaaactgtctcaagtgagctatcgtgcagggagggccagagctattggactgggtcctttagccccaagtgcctgagctcaagaagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctcatag

SEQ ID NO: 4436 - RNA, 3480 nt, synthetic construct
  misc_feature 1..3480: note = derived and/or modified CDS sequence (wt) from RVFV(73HB1230)__DQ380221.1__NSm-Gn-Gc
  source 1..3480: mol_type = other RNA
atgattgaaggagcttgggattcgctcagagaggaggagatgccagaggagctctcctgttctatatcaggcataagggaggttaagacctcaagccaggagttgtacagggcattaaaagccatcattgctgctgatggcttgaacaacatcacctgccatggtaaggatcctgaggacaagatttctctcataaagggtcctcctcacaaaaagcgggtggggatagttcggtgtgagagacgaagagatgctaagcaagtagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcccaagtatgagctcactgaggactgcaacttttgtaggcagatgacaggtgctagcctgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagactaagaaggagctcaaaagctttgatatctctcagtgccccaagattggaggacatggtagtaagaagtgcactggggacgcagcattttgctctgcttatgagtgcactgctcagtacgccaatgcctattgttcgcatgctaatggttcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagtccttctaccgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgctccaaggaaagttctgaatccactaatgtggattacagccttcatcagatgggtgtataagaagatggttgctagagtggcagacaatattaatcaagtgaacagggaaataggatggatggaaggaggtcagttggtcctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgttaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgttggagagtgtcatgtgaataggtgtctgtcttggagggacaatgaaacttcagcagagttttcatttgttggggaaagcacgatcatgcgagagaataagtgttttgagcagtgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacgacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagctgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctgttggtgaaagggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgtctgtatgttgcattatcaattgggctctttttcctccttatatatcttggaagaacaggcctctctaaaatgtggcttgctgctactaagaaggcctcatag

SEQ ID NO: 4437 - RNA, 3480 nt, synthetic construct
  misc_feature 1..3480: note = derived and/or modified CDS sequence (wt) from RVFV(1260/78)__DQ380214.1__NSm-Gn-Gc
  source 1..3480: mol_type = other RNA
atgattgaaggagcttgggattcactcagagaggaggagatgccagaggagctctcctgttctatatcaggcataagagaggttaagacctcaagccaggagttatacagggcattaaaagccatcattgctgctgatggcttgaacaacatcacctgccatggtaaggatcctgaggacaagatttctctcataaagggtcctcctcacaaaaagcgggtgggaatagttcggtgtgagagacgaagagatgctaagcaaatagggagagaaaccatggcagggattgcaatgacagtccttccagccttagcagtttttgctctagcacctgttgtttttgctgaagacccccatctcagaaacagaccggggaaggggcacaactacattgacgggatgactcaggaggatgccacatgcaaacctgtgacatatgctggggcatgtagcagttttgatgtcttgcttgaaaaagggaaatttcccctcttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcacagaggactgcaacttttgtaggcagatgacaggtgctagcctgaagaaggggtcttatcctctccaagacttattttgtcagtcaagtgaggacgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcacaagggacagtataagggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcttattgttcacatgctaatgggtcagggattgtgcaaatacaagtatcaggggtctggaagaagcctttatgtgtagggtatgagagagtggttgtaaagagagaactctctgccaagcccatccagagagttgagccttgcacaacttgtataaccaaatgtgagcctcatggattggttgtccgatcaacagggttcaaaatatcatctgcagttgcttgtgctagcggagtttgcgtcacaggatcgcagagtccttccaccgagattacactcaagtatccagggatatcccagtcctctgggggggacataggggttcacatggcacatgatgaccagtcagttagctccaaaatagtagctcactgccctccccaggacccgtgcttagtgcatggctgcatagtgtgtgctcatggcctgataaattaccagtgtcacactgctctcagtgcctttgttgttgtgtttgtgttcagttctattgcaataatttgtttagctattcttcatagggtgctcaagtgcttaaagattgccccaaggaaggttctgaatccactaatgtggattacagccttcatcagatgggtgtataagaagatggttgccagagtggcagacaatattaatcaagtgaacagggaaataggatggatggaaggaggtcagttggttctagggaaccctgcccctattcctcgccatgccccaattccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtctgatgttgaagggggtcaaggacgatcaaaccaagttcttaaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagggacaatgaaacttcagcagagttttcatttgttggggaaagcacgaccatgcgggagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcacactagagatcacagactttgatggctctgtttcaacaatagacctgggggcatcatctagccgtttcacaaactggggttcagttagcctctcactggacgcagagggcatttcaggctcaaatagcttttctttcattgaaagcccaggcaaaggatatgcaattgttgatgagccattctcagaaattcctcgacaagggttcctgggggagatcaggtgcaattcagagtcctcagtcctgagtgctcatgaatcatgccttagggcaccaaaccttatctcatacaagcccatgatagaccaattggagtgcacaacgaatctgattgatccctttgttgtctttgagaggggttctctgccacagacaaggaatgacaaaacctttgcagcttcaaaaggaaatagaggtgtccaagctttctctaagggctctgtacaagctgatctaactctgatgtttgacaattttgaggtggactttgtgggagcagccgtatcttgtgatgccgccttcctaaatttgacaggttgctattcttgcaatgcaggggccagggtctgcctgtctatcacatccacaggaactggaaccctctctgcccacaataaggatgggtctctgcatatagttcttccatcagagaatggaacaaaagatcaatgccagatactacacttcactgtacctgaggtagaggaggagtttatgtactcttgtgacggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctcctcatatatcttggaagaacaggcctctctaaaatgtggcttgccgctactaagaaggcctcatag

SEQ ID NO: 4438 - RNA, 3480 nt, synthetic construct
  misc_feature 1..3480: note = derived and/or modified CDS sequence (wt) from RVFV(ZC-3349)__DQ380207.1__NSm-Gn-Gc
  source 1..3480: mol_type = other RNA
atgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctactgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcaggcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagcctttatcagatggatatataagaagatggttgccagagtggcagacaacattaatcacgtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttaaggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctatctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaaccatactcctcatttgcctgtatgttgcattatcaattgggctctttttcctccttatatatcttggaagaacaggcctctctaaaatgtggcttgctgccactaagaaggcctcatag

SEQ ID NO: 4439 - RNA, 3480 nt, synthetic construct
  misc_feature 1..3480: note = derived and/or modified CDS sequence (wt) from RVFV(Sudan 85-2010)__JQ820488.1__NSm-Gn-Gc
  source 1..3480: mol_type = other RNA
atgattgaaggagcttgggattcactcagagaggaggagatgccagaggaactctcctgctctgtatcaggcataagggaggttaagacctcaagccaggagttatacagagcattaaaagccatcattgctgctgatggcctgaacaacatcacctgccatggtaagaatcctgaggacaagatttctctcataaagggccctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgcccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcacagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcgtatttgtattcagttctattgcaataatttgcttagccattctttatagggtgctcaagtgcttaaagattgccccaaggaaagttctgaatccactaatgtggattacagccttcatcagatgggtgtataagaagatggttgctagagtggcagacaatattaatcaagtgaacagagaaataggatggatggaaggaggtcagttggttctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaagaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaacaagtgttttgagcagtgtggaggatgggggtgtggatgcttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggctcagttagcctctcactggacgcagagggcatttcaggctcaaatagcttttcttttattgagagcccaggcaaagggtatgcaattgttgatgagccattctcagagatccctcggcaagggttcttgggggagattaggtgtaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaacaaggacgggtctctgcatatagttctcccatcagagaatgggacaaaagatcagtgtcagatactacatttcactgtacctgaagtagaagaggagttcatgtactcttgtgatggagatgagcggcctctgttagtgaaagggaccctgatagctattgacccatttgatgataggcgggaagcagggggggaatcaacagttgtgaatccaaaatctggatcttggaacttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4440 - RNA, 3480 nt, synthetic construct
  misc_feature 1..3480: note = derived and/or modified CDS sequence (wt) from RVFV(2007000324)__JF326195.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaagggaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4441 - RNA, 3480 nt, synthetic construct
  misc_feature 1..3480: note = derived and/or modified CDS sequence (wt) from RVFV(OS-8)__DQ380185.1__NSm-Gn-Gc
  source 1..3480: mol_type = other RNA
atgattgagggagcttgggattcactcagagaggaggagatgccagaggagctctcctgctctatatcaggcataagggaggttaagacctcaagccaggaattatacagagcattaaaagccatcattgctgctgatggcttgaacaacatcacctgccatggtaaggatcctgaggacaagatttctcttataaagggtcctcctcacaaaaagcgggtggggatagttcggtgtgagagacgaagagacgctaagcaaatagggagagaaaccatggcagggattgcaatgacagtccttccagccttagcagtttttgctttggcacctgttgtatttgctgaagacccccatctcagaaatagaccagggaaggggcacaactacattgacgggatgactcaggaggatgccacttgtaaacctgtgacatacgctggggcatgtagcagttttgatgtcttgctcgaaaagggaaaattccccctcttccagtcgtatgctcatcatagaactctactagaggcagttcatgacaccatcattgcaaaggctgatccacctagttgtgatcttcagagtgctcatgggaatccttgcatgaaagagaaactcgtgatgaagacacactgtccaaatgactaccagtcagcccactacctcaacaatgatgggaaaatggcctcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaggcactcaagaagtgtgatggccagctcagcactgcacatgaggttgtgccctttgcagtgtttaagaactcaaagaaggtttatcttgacaagcttgacctcaaaactgaagaaaatctgctaccagactcatttgtctgcttcgagcataagggacagtataaaggaacaatggactctggtcaaactaagagggagctcaaaagctttgatatctctcagtgccccaagattggaggacatggtagcaagaagtgcactggggacgcagcattttgctctgcttatgagtgcactgctcaatacgccaatgcctattgttcacatgctaatgggtcaggagttgtgcagatacaagtatccggggtctggaagaaacctttatgtgtagggtatgagagagtggttgtgaagagagaactctctgccaaacccatccagagagttgagccttgcacaacctgtataaccaaatgtgagcctcatggattggttgtccgatcaacagggttcaagatatcatctgcagttgcatgtgctagcggagtttgtgtcacaggatcgcagagtccttctaccgagatcacactcaagtatccagggatatcccagtcctctgggggggacataggggttcacatggcacacgatgatcagtcagttagctccaaaatagtagctcactgccccccccaggacccgtgcctagtgcatggctgcatagtgtgtgctcatggcctaataaattaccagtgtcacactgctctcagtgcctttgttgttgtgttcgtattcagctctgttgcaataatttgtttggccattctttataaggtgctcaagtgcctaaagattgccccaaggaaagttctaaatccactaatgtggattactgccttcatcagatgggtgtataagaagatggttgccagggtggcagacaatattaatcaagtgaacagagaaataggatggatggagggaggtcagttggctctagggaaccctgcccctattcctcgtcatgccccaattccacgttatagcacatacctgatgctactattgattgtctcatatgcatcagcatgttcagaactgattcaggcaagctctagaataaccacttgctccacagaaggtgtcaacaccaagtgtaggctgtctggcacagcattaatcagggcagggtcagttggggcagaggcttgcttgatgttaaagggagtcaaggaggaccaaacaaagttcttgaggataaaaactgtctcaagtgagctatcgtgcagggaaggccagagctattggactggatcctttagtcccaaatgtctgagctcaaggagatgccatcttgtcggggaatgtcatgtgaataggtgtctgtcttggagggacaatgaaacttcagcagagttttcatttgttggggaaagcacgactatgcgagagaataaatgttttgagcagtgtgggggatggggatgtgggtgcttcaatgtgaacccatcttgcttgtttgtgcacacgtatctgcagtcagttagaaaagaggcccttagagtttttaactgtatcgattgggtgcataaactcactctagagatcacagactttgatggttctgtttcaacaatagacttgggagcatcatctagccgtttcacaaactggggctcagttagcctctcactggatgcagagggcatttcaggctcaaatagcttttctttcattgagagcccaggcaaagggtatgcaattgttgatgagccattctcagaaatccctcggcaagggttcttgggggagatcaggtgcaattcagaatcttcagtcctgagtgctcatgaatcatgccttcgggcaccaaacctcatctcatacaagcccatgatagaccagttggagtgcacaacaaatctgattgatccctttgttgtctttgagaggggttctctgcctcagacaaggaatgataaaacttttgcagcttcaaaaggaaataggggtgttcaagctttctctaagggctctgtacaagctgatttaactctgatgtttgacaattttgaggtggactttgtgggagcagccgtgtcttgtgatgccgctttcttaaatctgtcaggttgttattcttgtaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatcgccattgatccatttgatgacaggcgggaagcagggggagaatcaacagttgtgaatccaaaatctggatcttggaatttctttgactggttttctggactcatgagttggtttggagggcctcttaagactatactcctcatttgcctgtatgttgcattatcaattgggctctttttccttctcatatatcttggaagaacaggtctctctaaaatgtggcttgctgctactaagaaggcctcataa

SEQ ID NO: 4442 - RNA, 3480 nt, synthetic construct
  misc_feature 1..3480: note = derived and/or modified CDS sequence (wt) from RVFV(ZINGA J83 R1)__KU978776.1__NSm-Gn-Gc
  source 1..3480: mol_type = other RNA
atgattgaaggagcttgggattcactcagagaggaggagatgccagaggagctctcctgttctatatcaggcataagggaggttaagacctcaagccaggagttatacagggcattaaaagccatcattgctgctgatggcttgaacaacatcacctgccatggtaaggatcctgaggacaagatttctctcataaagggtcctcctcataaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgagaaggggaaattcccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggctgatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttaccttgataagcttgacctcaagactgaggagaatctgctaccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtagttgtgaagagagaactctctgccaagcccatccagagagttgagccttgcacaacttgtataaccaaatgtgagcctcatgggttggttgtccgatcaacagggttcaagatatcatctgcagttgcttgtgctagcggagtttgcgtcacaggatcgcagagtccttccaccgagattacactcaagtatccagggatatcccagtcctctggaggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgccccaaggaaagttctgaatccactaatgtggattacagccttcatcagatgggtgtataggaagatggttgccagagtggcagacaatattaatcaagtgaacagggagataggatggatggaaggaggtcagttggttctagggaaccctgcccctattcctcgtcatgttccaattccacgttatagcacatacctaatgctactactgattgtctcatatgcatcagcatgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggagaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctggagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgagtcatgccttagggcaccaaaccttatctcatacaagcccatgatagatcaattggagtgcacaacaaatctgattgacccctttgttgtatttgagaggggttctctgccacagacaaggaatgacaaaacctttgctgcttcaaaaggaaatagaggtgttcaagctttctctaagggctctgtgcaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctattggtgagggggactctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcttgtatgttgcattatcaattgggctctttttcctcctcatatatcttggaagaacaggcctctctaaaatgtggcttgctgctactaagaaggcctcatag

SEQ ID NO: 4443 - RNA, 3480 nt, synthetic construct
  misc_feature 1..3480: note = derived and/or modified CDS sequence (wt) from RVFV(2007000253)__JF326192.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcaccagttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagctggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4444 - RNA, 3480 nt, synthetic construct
  misc_feature 1..3480: note = derived and/or modified CDS sequence (wt) from RVFV(MP12)__Z30318.1__NSm-Gn-Gc
  source 1..3480: mol_type = other RNA
atgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagaaaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcatcacctcaacaatgacgggaaaatggcttcagtcaagtgccctcctaagtatgagctcactgaagactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcacacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagttaaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaggaacaggcctctctaaaatgtggcttgctgccactaagaaggcctcatag

SEQ ID NO: 4445 - RNA, 3480 nt, synthetic construct
  misc_feature 1..3480: note = derived and/or modified CDS sequence (wt) from RVFV(BIME-01)__KX609032.1__NSm-Gn-Gc
  source 1..3480: mol_type = other RNA
atgattgaaggagcttgggattcactcagagaggaggagatgccagaagagctctcctgttccatatctggcataagggaggtcaagacctcaagccaggaattatacagggcattaaaagccatcattgctgctgatggcttgaacaacatcacctgccatggtaaggatcctgaggacaaaatttctctcataaagggtcctcctcacaagaagcgggtggggatagttcggtgtgagagacgaagggacgctaagcaaatagggagagaaaccatggcagggattgcaatgacagttcttcccgccttagcagtttttgctttggcacctgttgtttttgctgaggaccctcatctcagaaacagaccagggaagggacataactacattgacgggatgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgatccacctagctgtgatctccagagtgctcatgggaatccctgcatgaaagagaaactcgtgatgaagacacactgtccaaatgactaccagtcagctcattacctcaacaatgacgggaaaatggcttcagtcaagtgccctcctaagtatgagcttactgaggactgcaacttttgtaggcagatgacaggtgctagcttgaagaaggggtcttatcctctccaggacttattttgtcagtcaagtgaggatgatggatcaaaactaaagacaaaaatgaaaggggtctgcgaagtgggggttcaggcactcaaaaagtgtgatggccaactcagcactgcacatgaggttgtgccctttgcagtgtttaagaattcaaagaaggtttatcttgacaagcttgaccttaagactgaagaaaatctgctaccagactcatttgtctgctttgagcataagggacagtataaaggaacaatggactctggtcagactaagagggagctcaaaagctttgatatctctcagtgccccaagattgggggacatggtagcaagaagtgcactggggacgcagcattttgctctgcttatgagtgtactgctcaatatgccaatgcctattgttcacatgctaatgggtctgggattgtacagatacaagtatccggggtctggaagaagcctttatgtgtggggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgccagcggagtttgcgtcacaggatcgcagagcccttctactgagatcactctcaagtatccagggatatcccagtcctctgggggggatataggggttcacatggcacatgatgatcagtcagttagctccaaaatagtggctcactgccccccccaggacccgtgcctagtgcatggctgcatagtgtgtgctcatggcttgataaattaccagtgtcacactgctcttagtgcttttgttgttgtgttcgtattcagctctgttgcaataatttgtctggccattctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgctcccattcctcgtcatgctccgattccacgttatagcacatacctaatgctactattgattatctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttaatgttaaagggggtcaaggaagaccagaccaagttcttgaagataaaaactgtctcaagtgagctatcgtgcagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtggatgtttcaatgtgaacccatcttgcttatttgtgcacacgtatctgcaatcagttagaaaagaggctcttagagtttttaactgtattgattgggtgcataaactcactctagagatcacagactttgatggctctgtttcaacaatagacttgggagcatcatctagccgtttcacaaactggggctcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttctgtcctgagtgctcatgagtcatgccttagggcaccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaaaggctctgtacaggctgatctaactctgatgtttgacaattttgaggtggactttgtgggagcagccgtgtcttgtgatgccgccttcttaaatttgacaggttgctattcctgcaatgctggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagttcatgtactcttgtgatggagatgagcgacctttgttggtgaaggggaccctaatagctattgatccatttgatgataggcgagaagcagggggagaatcaacagttgtgaatccaaaatctggatcttggaacttctttgactggttttctggacttatgagttggtttggaggacctcttaagactatactcctaatttgcctgtatgtagcattatcaattgggctctttttccttcttatatatcttggaagaacaggtctctctaaaatgtggcttgctgccactaagaaagcctcatag

SEQ ID NO: 4446 - RNA, 3480 nt, synthetic construct
  misc_feature 1..3480: note = derived and/or modified CDS sequence (wt) from RVFV(200803166)__JF311381.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccctagcggtttttgctttagcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttaaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggatccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagggaaataggatggatggaaggaggtcagttggttctagggaaccctgcccctattcctcgtcatgccccaatcccacgttatagcacatacctaatgctactattgattgtctcatatgcaacagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggttaaggaagatcaaaccaagttcttgaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagtctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatgtagttctcccatcagagaatgggacaaaagatcagtgtcagatactgcatttcactgtacctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4447 - RNA, 3480 nt, synthetic construct
  misc_feature 1..3480: note = derived and/or modified CDS sequence (wt) from RVFV(Kenya 83 (21445))__DQ380198.1__NSm-Gn-Gc
  source 1..3480: mol_type = other RNA
atgattgaaggagcttgggattcactcagagaggaggagatgccagaggagctctcctgctctatatcaggcataagggaggttaagacctcaagccaagagttatacagggcattaaaagccatcattgctgctgatggcttgaacaacatcacctgccatggtaagaatcctgagaacaagatttctctcataaagggtcctcctcacaaaaagcgggtggggatagtccggtgtgagagacgaagagatgctaagcaaatagggagagaaaccatggcagggattgcaatgacagtccttccagccttagcagtttttgctttggcacctgttgtttttgctgaagacccccacctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaactcgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaaaaaggggtcttaccctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgtttcgagcataagggacagtataaaggaacaatggactctggtcagaccaagagggagctcaaaagctttgatatctctcagtgccccaagattggagggcatggtagtaagaagtgcactggggacgcagcattctgctctgcttatgagtgcactgctcagtacgccaatgcctattgttcacatgctaatgggtcagggattgtgcagattcaagtatcaggggtctggaagaagcctttatgtgtagggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgctagcggggtttgcgtcacaggatcgcagagtccttctactgagattacactcaagtatccagggatatctcagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagctttcatcagatgggtgtataagaagatggttgctagagtggcagacaacattaatcaagtgaacagggaaataggatggatggaaggaggtcagttggctctagggaaccctgcccctattcctcgtcatgccccaatcccacgttatagcacatacctaatgctactattgattgtctcatatgcatcagcatgttcagaactgatccaggcaagctccagaatcaccacttgctccacagagggtgtcaacaccaagtgtagactgtctggcacagcattgatcagggcagggtcagttggggcagaggcttgtttgatgttgaagggggtcaaggaggatcaaaccaaattcttaaagataaaaacagtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggttcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgacccctttgttgtctttgagaggggttctctgccacagacaaggaatgacaaaacctttgcagcttcaaaaggaaatagaggtgttcaggctttctctaagggctctgtacaagctgatctgactctgatgtttgacaattttgaggtggactttgtgggagcagccgtgtcttgtgatgccgccttcttgaatttgacaggttgctattcttgtaatgcaggggccagggtctgcctgtctatcacatccacaggaactggaactctctctgcccacaataaggatgggtctctgcatatagttctcccatcagagaatgggacaaaagatcagtgtcagatactacacttcactgtacctgaagtagaggaggagtttatgtactcttgtgatggagatgagcggcctctgttagtgaaagggaccctgatagctattgacccatttgatgataggcgggaagcaggaggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgccgctactaagaaggcctcatag

SEQ ID NO: 4448 - RNA, 3480 nt, synthetic construct
  misc_feature 1..3480: note = derived and/or modified CDS sequence (wt) from RVFV(Entebbe)__DQ380191.1__NSm-Gn-Gc
  source 1..3480: mol_type = other RNA
atgattgaaggagcttgggattcactcagagaggaggagatgccagaggagctctcctgttccatatcaggcataagggaggttaagacctcaagccaggaattacacagggcattaaaagccatcattgctgctgatggcttgaacaacatcacctgccatggtaaggatcctgaggacaagatttctctcataaaaggtcctcctcacaaaaagcgggtgggggtagttcggtgtgagagacgaagagacgctaagcaaatagggagagaaaccatggcagggattgcaatgacagtccttccagccttagcagtttttgctttggcacctgttgtttttgctgaagaccctcatctcagaaacagaccagggaagggacacaactacattgacgggatgactcaggaggatgccacatgtaaacctgtgacatatgctggggcatgtagcagttttgatgtcttgctcgaaaagggaaaatttcccctcttccagtcgtatgctcatcatagaactctattagaggcagttcacgacaccatcattgcaaaggctgatccacctagctgtgaccttcagagtgctcatgggaatccctgcatgaaagagaaactcgtaatgaagacacactgtccaaatgactaccagtcagctcattacctcaacaatgacgggaaaatggcttcagtcaagtgccctcctaagtatgagctcactgaggactgcaacttttgtaggcagatgacaggtgctagcttgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgacaagcttgacctcaagactgaggaaaatctgctaccagactcatttgtctgcttcgagcataagggacagtacaaaggaacaatggactctggtcagattaagagggagctcaaaagctttgatatctctcagtgccccaagattggaggacatggtagcaagaagtgcactggggacgcagcattttgctctgcttatgagtgtactgctcaatacgccaatgcctattgttcacatgctaatgggtcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctactgagattacactcaagtatccagggatatcccagtcctctgggggagacataggggttcacatggcacatgatgatcagtcagttagctccaaaatagtagctcactgccccccccaggacccgtgcctagtgcatggctgcatagtgtgtgctcatggcttgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcagatgggtgtataagaagatggttgctagagtggcagacaatatcaatcaagtgaacagggaaataggatggatggaaggaggccagttggttctagggaaccctgcccctattcctcgtcatgctccaattccacgttatagcacatacctaatgctgctattgattgtctcatatgcatcagcatgttcagaactaattcaggcaagctccagaatcaccacctgctccacagaaggtgtcaacaccaagtgtaggctgtctggcacagcattaatcagggcagggtcagttggggcagaggcttgtttgatgttaaagggggtcaaggaagaccagaccaagttcttgaagataaaaactgtctcaagtgagctatcgtgtagggagggccagagctattggactgggtcctttagccccaaatgtctgagctcaaggagatgccatcttgtcggagaatgtcatgtgaataggtgtctgtcttggagggacaatgagacttcagcagaattttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtattgattgggtgcataaactcactctagagatcacagactttgatggctctgtttcaacagtagacttgggagcatcatctagccgtttcacaaactggggttcagttagcctctcactggacgcagagggcatttcaggctcaaatagcttctctttcattgagagcccaggcaaagggtatgcaattgttgatgagccattctcagaaattcctcggcaagggttcttgggagagatcaggtgcaattcagaatcttcagtcctgagtgctcatgaatcatgccttagggcaccaaaccttatctcatacaaacccatgatagatcagttggagtgcacaacaaatctgattgatccctttgttgtctttgagaggggttctctgcctcagacaaggaatgacaaaacctttgcagcttcaaaaggaaataggggtgttcaagctttctctaagggctctgtacaagctgatctaactctgatgtttgacaattttgaggtggactttgtgggagcagccgtgtcttgtgatgccgccttcttaaacttgacaggttgctattcctgcaatgcaggggccagagtctgtctgtctatcacatctacaggaactggaactctttctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaggggaccctgatagctattgatccatttgatgataggcgagaagcagggggggaatcaacagttgtgaatccaaaatctggatcttggaacttctttgactggttttctggacttatgagttggtttggagggcctcttaagactatactcctaatttgcctgtatgtagcattatcaattgggctctttttccttcttatatatcttggaagaacaggtctctccaaaatgtggcttgctgccactaagaaagcttcatag

SEQ ID NO: 4449 - RNA, 3480 nt, synthetic construct
  misc_feature 1..3480: note = derived and/or modified CDS sequence (wt) from RVFV(763/70)__DQ380188.1__NSm-Gn-Gc
  source 1..3480: mol_type = other RNA
atgattgaaggagcttgggattcactcagagaggaggagatgccagaagagctctcctgttccatatcaggcataagggaggtcaaaacctcaagccaggaattatatagggcattaaaagccatcattgctgctgatggcttgaacaacatcacctgccatggtaaggatcctgaggataagatttctctcgtaaagggtcctcctcacaaaaagcgggtggggatagttcggtgtgagagacgaagagacgctaagcaaataggaagagaaaccatggcagggattgcaatgacagtccttccagccttagcagtttttgctttggcacctgttgtttttgctgaagaccctcatctcagaaacagaccagggaaggggcacaactacattgacgggatgactcaggaggacgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccctgcatgaaggagaaactcgtgatgaagacacactgtccaaatgactaccagtcagctcattacctcaacaatgacgggaaaatggcttcagtcaagtgccctcctaaatatgggctcactgaggactgcaatttttgcaggcagatgacaggtgctagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctcaaaagctttgatatctctcagtgccccaagattggaggacatggtagcaagaagtgcactggggacgcagctttttgctctgcttatgagtgcactgctcaatacgccaatgcttattgttcacatgctaatgggtcaggaattgtacagatacaagtatccggggtctggaagaagcctttgtgtgtcgggtatgagagggtggttgtgaagagagaactctctgctaagcccatccagagagttgagccttgcacaacttgtataaccaaatgtgagcctcacggattggttgtccgatcaacaggtttcaagatatcatctgcagttgcttgtgctagcggagtttgcgttacaggatcgcagagcccttctaccgagatcacactcaagtatccagggatatcccagtcctctgggggggacataggggttcacatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctgaatccactaatgtggattactgctttcatcagatgggtgtataagaagatggttgccagagtggcagacaatatcaatcaggtgaacagggaaataggatggatggaaggaggccagctggctctagggaaccctgcccctattcctcgtcatgctccaattccacgttatagcacatacttaatgctactattgattgtctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagagacaatgaaacctcagcagaattttcatttgttggggaaagcacgaccatgcgggagaataagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgacggctctgtttcaacaatagacctgggagcatcatctagccgtttcacaaactggggttcagttagcctctcactggacgcagagggcatttcaggctcaaacagcttttccttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaatcttatttcatacaagcccatgatagatcagttggagtgcacaacaaatctgattgatccctttgttgtctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatgggtctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttccttcttatatatcttggaagaacaggcctctctaaaatgtggcttgctgccaccaagaaagcctcatag

SEQ ID NO: 4450 - RNA, 3480 nt, synthetic construct
  misc_feature 1..3480: note = derived and/or modified CDS sequence (wt) from RVFV(OS-1)__DQ380186.1__NSm-Gn-Gc
  source 1..3480: mol_type = other RNA
atgattgagggagcttgggattcactcagagaggaggagatgccagaggagctctcctgctctatatcaggcataagggaggttaagacctcaagccaggaattatacagagcattaaaagccatcattgctgctgatggcttgaacaacatcacctgccatggtaaggatcctgaggacaagatttctcttataaagggtcctcctcacaaaaagcgggtggggatagtccggtgtgagagacaaagagacgctaagcaaatagggagagaaaccatggcagggattgcaatgacagtccttccagccttagcagtttttgctttggcacctgttgtatttgctgaagacccccatctcagaaatagaccagggaaggggcacaactacattgacgggatgactcaggaggatgccacttgtaaacctgtgacatatgctggggcatgtagcagttttgatgtcttgctcgaaaagggaaaattccccctcttccagtcgtatgctcatcatagaactctactagaggcagttcatgacaccatcattgcaaaggctgatccacctagttgtgatcttcagagtgctcatgggaatccttgcatgaaagagaaactcgtgatgaagacacactgtccaaatgactaccagtcagcccactacctcaacaatgatgggaaaatggcctcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaggcactcaagaagtgtgatggccagctcagcactgcacatgaggttgtgccctttgcagtgtttaagaactcaaagaaggtttatcttgacaagcttgacctcaaaactgaagaaaatctgctaccagactcatttgtctgcttcgagcataagggacagtataaaggaacaatggactctggtcaaactaagagggagctcaaaagctttgatatctctcagtgccccaagattggaggacatggtagcaagaagtgcactggggacgcagcattttgctctgcttatgagtgcactgctcaatacgccaatgcctattgttcacatgctaatgggtcaggagttgtgcagatacaagtatccggggtctggaagaaacctttatgtgtagggtatgagagagtggttgtgaagagagaactctctgccaaacccatccagagagttgagccttgcacaacctgtataaccaaatgtgagcctcatggattggttgtccgatcaacagggttcaagatatcatctgcagttgcatgtgctagcggagtttgtgtcacaggatcgcagagtccttctaccgagatcacactcaagtatccagggatatcccagtcctctgggggggacataggggttcacatggcacacgatgatcagtcagttagctccaaaatagtagctcactgccctccccaggacccgtgcctagtgcatggctgcatagtgtgtgctcatggcctaataaattaccagtgtcacactgctctcagtgcctttgttgttgtgttcgtattcagctctgttgcaataatttgtttggccattctttataaggtgctcaagtgcctaaagattgccccaaggaaagttctaaatccactaatgtggattactgccttcatcagatgggtgtataagaagatggttgccagggtggcagacaatattaatcaagtgaacagagaaataggatggatggagggaggtcagttggctctagggaaccctgcccctattcctcgtcatgccccaattccacgttatagcacatacctgatgctactattgattgtctcatatgcatcagcatgttcagaactgattcaggcaagctctagaataaccacttgctctacagaaggtgtcaacaccaagtgtaggctgtctggcacagcattaatcagggcagggtcagttggggcagaggcttgcttgatgttaaagggagtcaaggaggaccaaacaaagttcttgaagataaaaactgtctcaagtgagctatcgtgcagggaaggccagagctattggactggatcctttagtcccaaatgtctgagctcaaggagatgccatcttgtcggggaatgtcatgtgaataggtgtctgtcttggagggacaatgaaacttcagcagagttttcatttgttggggaaagcacgactatgcgagagaataaatgttttgagcagtgtgggggatggggatgtgggtgcttcaatgtgaacccatcttgcttgtttgtgcacacgtatctgcagtcagttagaaaagaggcccttaaagtttttaactgtatcgattgggtgcataaactcactctagagatcacagactttgatggttctgtttcaacaatagacttgggagcatcatctagccgtttcacaaactggggctcagttagcctctcactggatgcagagggcatttcaggctcaaatagcttttctttcattgagagcccaggcaaagggtatgcaattgttgatgagccattctcagaaatccctcggcaagggttcttgggggagatcaggtgcaattcagaatcttcagtcctgagtgctcatgaatcatgccttcgggcaccaaacctcatctcatacaagcccatgatagaccagttggagtgcacaacaaatctgattgatccctttgttgtctttgagaggggttctctgcctcagacaaggaatgataaaacttttgcagcttcaaaaggaaataggggtgttcaagctttctctaagggctctgtacaagctgatttaactctgatgtttgacaattttgaggtggactttgtgggagcagccgtgtcttgtgatgccgctttcttaaatctgacaggttgttattcttgtaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatcgccattgatccatttgatgacaggcgggaagcagggggagaatcaacagttgtgaatccaaaatctggatcttggaatttctttgactggttttctggactcatgagttggtttggagggcctcttaagactatactcctcatttgcctgtatgttgcattatcaattgggctctttttccttctcatatatcttggaagaacaggtctctctaaaatgtggcttgctgctactaagaaggcctcataa

SEQ ID NO: 4451 - RNA, 3480 nt, synthetic construct
  misc_feature 1..3480: note = derived and/or modified CDS sequence (wt) from RVFV(2008/00101)__HE687306.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaactatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggcattctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactacactcctcatttgcctgtatgttgcattatcaattgggctcttcttcctccttatatatcttggaagaacaggcctctctaaaatgtggcttgccgctactaagaaggcctcatag

SEQ ID NO: 4452 - RNA, 3480 nt, synthetic construct
  misc_feature 1..3480: note = derived and/or modified CDS sequence (wt) from RVFV(200803162)__JF311377.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaaatatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtatagccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctaaggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4453 - RNA, 3480 nt, synthetic construct
  misc_feature 1..3480: note = derived and/or modified CDS sequence (wt) from RVFV(2007002060)__EU574039.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaaaagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgattaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4454 - RNA, 3480 nt, synthetic construct
  misc_feature 1..3480: note = derived and/or modified CDS sequence (wt) from RVFV(2007002476)__EU574036.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcaaatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4455 - RNA, 3480 nt, synthetic construct
  misc_feature 1..3480: note = derived and/or modified CDS sequence (wt) from RVFV(2269/74)__DQ380222.1__NSm-Gn-Gc
  source 1..3480: mol_type = other RNA
atgattgaaggagcttgggattcgctcagagaggaggagatgccagaggagctctcctgttctatatcaggcataagggaggttaagacctcaagccaggaattgtacagggcattaaaagccatcattgctgctgatggcttgaacaacatcacctgccatggtaaggaccctgaggacaagatttctctcataaagggtcctcctcacaaaaaacgggtggggatagttcggtgtgagagacgaagagacgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgtaaacctgtgacatatgctggggcatgtagcagttttgatgtcttgctcgaaaaggggaaattccccctcttccagtcgtatgctcatcatagaactctactagaggcagttcacgacactatcattgcaaaggctgacccacctagctgtgaccttcagagtgctcatgggaatccctgcatgaaagagaagctcgtgatgaagacacactgtccaaatgactaccaatcagctcattaccttaacaatgacgggaaaatggcttcagtcaagtgcccccctaagtatgagctcactgaggattgcaacttttgtaggcagatgacaggtgctagcctgaagaaggggtcttatcctctccaggacttattttgtcagtcaagtgaggatgatgggtcaaaattaaaaacaaaaatgaaaggggtctgcgaagtgggagttcaagcactaaaaaagtgtgatggccaactcagcactgcacatgaggttgtgcccttcgcagtgtttaagaactcaaagaaggtttatcttgataagcttgaccttaagactgaggaaaatctgctaccagactcatttgtctgcttcgagcataaaggacaacataaaggaacaatggactctggtcagaccaagagggagctcaaaagctttgatatctctcagtgccccaagattggaggacatggtagcaagaagtgcactggggacgcagcattttgctctgcttatgagtgcactgctcagtacgccaatgcctattgttcacatgctaatgggtcaggaattgtgcagatacaagtgtcaggggtctggaagaagcctttatgtgtagggtatgagagagtggttgtaaagagagaactctctgccaagcccatccagagagttgagccttgcacaacttgtataaccaaatgcgagcctcatggactggttgtccgatcaacagggttcaagatatcatctgcagttgcttgtgctagcggagtttgcgtcacaggatcgcagagtccttctaccgagattacactcaagtatccaggaatatctcagtcctctgggggggacataggggttcacatggcacacgacgatcagtcagttagctccaaaatagtagctcactgccccccccaggacccgtgcttagtgcatggctgcatagtgtgtgctcatggcctgataaattaccagtgtcacactgctctcagtgcctttgttgttgtgttcgtgttcagctctgttgcaataatttgtttggccattctttataaggtgctcaagtgcctaaagattgccccaaagaaagttctgaatccgctaatgtggattactgccttcatcagatgggtatataagaagatggttgccagagtggcagataatataaatcaagtgaacagggaaataggatggatggaaggaggtcagttggctctagggaaccctgcccctattcctcgtcacgctccaatcccacgctatagcacatacctaatgctactactgattgtctcatatgcgtcagcatgttcagaactgattcaggcaagctctaggattaccacttgctccacagaaggtgtcaacaccaagtgtaggctgtctggcacagcattaattagggcagggtcagttggggcagaggcttgtttgatgttaaagggggtcaaggaagaccaaaccaagttcttgaagataaaaactgtctcaagtgagctatcgtgcagggagggccagagctactggactgggtcctttagccccaaatgtctgagctcaaggagatgccatcttgtcggggaatgtcatgtgaataggtgcttgtcttggagggacaatgaaacttcagcagagttttcatttgttggggaaagcacgaccatgcgagagaataagtgttttgagcagtgtggaggatggggatgtgggtgtttcaatgtgaacccatcttgcttatttgtgcacacgtacctgcagtcagttagaaaagaggcccttagagtttttaactgtatcgattgggtgcataaactcactctagagatcacagactttgatggctctgtttcaacaatagacttgggagcatcatctagccgtttcacaaactggggttcagttagcctctcactggacgcagagggcatttcaggctcaaatagcttttcattcattgagagcccaggcaaagggtatgcaattgttgatgagccattctcagaaattcctcggcaagggttcctgggggagatcaggtgcaactcagaatcttcagtcctgagtgctcatgaatcatgccttagggcaccaaaccttatctcatacaagcctatgatagatcagttggagtgcacaacaaatctgattgatccctttgttgtctttgagaggggttctctgccacagacaagaaatgacaaaacttttgcagcttcaaaaggaaataggggtgttcaagctttctctaagggctctgtgcaagctgatctaactctgatgtttgacaattttgaggtggactttgtgggagcagccgtgtcttgtgatgccgccttcttaaatttgacaggttgctattcttgcaatgcaggggccagggtctgcctgtctatcacatccacaggaactggaactctctctgcccacaacaaggatgggtctctgcatatagttctcccatcagaaaatggaacaaaagatcagtgtcagatactacacttcactgtgcctgaggtagaggaggagtttatgtactcttgtgatggagatgagcggcctttgttagtgaaggggaccctgatagccattgatccatttgatgataggcgggaagcaggaggggaatcaacagttgtgaatccaaaatctggatcttggaatttctttgactggttctctggactcatgagttggtttggagggcctcttaagaccatactcctcatatgcctgtatgttgcattatcaattgggctctttttccttcttatatatcttggaagaacaggtctctctaaaatgtggcttgctgctactaagaaggcttcatag

SEQ ID NO: 4456 - RNA, 3480 nt, synthetic construct
  misc_feature 1..3480: note = derived and/or modified CDS sequence (wt) from RVFV(73HB1449)__DQ380211.1__NSm-Gn-Gc
  source 1..3480: mol_type = other RNA
atgattgaaggagcttgggattcactcagagaggaggagatgccagaggagctctcctgttctatatcaggcataagagaggttaagacctcaagccaggagttatacagggcattaaaagccatcattgctgctgatggcttgaacaacatcacctgccatggtaaggatcctgaggacaagatttctctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcccctcttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcacagaggactgcaacttttgtaggcagatgacaggtgctagcctgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcacaagggacagtataagggaacaatggactctggtcagactaagagggagctcaaaagctttgatatttctcagtgccccaagattggaggacatggtagtaagaagtgcactggggacgcagcattttgctctgcttatgagtgcactgctcagtatgccaatgcttattgttcacatgctaatgggtcagggattgtgcagatacaagtatcaggggtctggaagaagcctttatgtgtagggtatgagagagtggttgtgaagagagaactctctgccaagcccatccagagggttgagccttgcacaacttgtataaccaaatgtgagcctcatggattggttgtccgatcaacagggttcaagatatcatctgcagttgcttgtgctagcggagtttgcgtcacaggatcgcagaatccttccaccgagatcacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgttcgtgttcagttctattgcaataatttgtttagctattctttatagggtgctcaagtgcctaaagattgccccaaggaaagttctgaatccactaatgtggattacagccttcatcagatgggtgtataagaagatggttgccagagtggcagacaatattaatcaagtgaatagggaaataggatggatggaaggaggtcagttggtcctagggaaccctgcccctattcctcgccatgccccaattccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtctgatgttgaagggggtcaaggacgatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactaacactagagatcacagactttgatggctctgtttcaacaatagacctaggagcatcatctagccgtttcacaaactggggttcagtcagcctctcactggacgcagagggcatttcaggctcaaatagcttttctttcattgagagcccaggcaaagggtatgcaattgttgatgagccattctcagaaattcctcggcaagggttcctgggggagatcaggtgcaattcagagtcctcagtcctgagtgctcatgaatcatgccttagggcaccaaaccttatctcatacaagcccatgatagaccaattggagtgcacaacgaatctgattgatccatttgttgtctttgagaggggttctctgccacagacaaggaatgaaaaaacctttgcagcttcaaaaggaaatagaggtgtccaagccttctctaagggctctgtacaagctgatctaactctgatgtttgacaattttgaggtggattttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcaatgccagatactacacttcactgtacctgaggtagaggaggagtttatgtactcttgtgacggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactccttatttgcctgtatgttgcattatcaattgggctctttttcctcctcatatatcttggaagaacaggcctctctaaaatgtggcttgctgctactaagaaggcctcatag

SEQ ID NO: 4457 - RNA, 3480 nt, synthetic construct
  misc_feature 1..3480: note = derived and/or modified CDS sequence (wt) from RVFV(SA-51 (Van Wyck))__DQ380195.1__NSm-Gn-Gc
  source 1..3480: mol_type = other RNA
atgattgaaggagcttgggattcactcagagaggaggagatgccagaggagctctcctgttctatatcaggcataagggaggttaagacctcaagccaggaattatacagggcattaaaagccatcattgctgctgatggcttgaacaacatcacctgccatggtaaggatcctgaggacaagatctctctcataaagggtcctcctcacaaaaaacgggtggggatagttcggtgtgagagacgaagagacgctaagcaaatagggagagaaaccatggcagggattgcaatgacagtccttccagccttagcagtttttgctttggcacctgttgtttttgctgaagacccccatctcagaaacagaccagggaagggacacaactacattgacgggatgactcaggaggatgccacatgtaaacctgtgacatatgctggggcatgtagcagttttgatgtcttgctcgaaaagggaaaatttcccctttttcagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaacgacgggaaaatggcttcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaaaactgaggaaaatctgctaccagactcatttgtctgcttcgagcataagggacagtataaaggaacaatggactctggtcagactaagagggagctcaagagctttgatatctctcagtgccccaagattggaggacgtggtagcaagaagtgcactggggacgcagcattttgctctgcttatgagtgcactgctcaatacgccaatgcctattgttcacatgctaatgggtcaggaattgtgcagatacaagtatcaggggtctggaagaagcctttatgtgtaggatatgagagagtggttgtgaaaagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctacagagattacactcaagtacccagggatatcccagtcctctggaggggacataggggttcacatggcacacgatgatcagtcagttagctccaaaatagtagctcactgccccccccaagacccgtgcttagtgcatggctgcatagtgtgtgctcatggcctgataaattaccagtgtcacactgctctcagtgcctttgttgttgtgttcgtattcagctctgttgcaataatctgtttagccattctttataaggtgctcaagtgcctaaagattgccccaaggaaagttctgaatccactaatgtggattactgccttcatcagatgggtgtataagaagatggttgccagagtggcagacaatattaatcaagtgaacagggagataggatggatggaaggaggtcagttggctctagggaatcctgcccctattcctcgtcatgctccaattccacgttatagcacatacctaatgctactattgattgtctcatatgcatcagcatgctcagaactgattcaggcaagctccagaatcaccacttgctctacagaaggtgtcaacaccaagtgtaggctgtctggcacagcattaatcagggcagggtcagttggggcagaggcttgtttgatgttgaagggggtcaaggaagaccaaaccaagttcttgaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggataatgaaacttcagcagagttttcatttgttggggaaagcacgaccatgcgagaaaataagtgttttgagcagtgtggaggatggggatgtgggtgtttcaatgtgaacccatcttgcttatttgtgcacacgtatctgcagtcagttagaaaagaggcccttagagtttttaactgtatcgattgggtgcataaactcactctggaggtcacagattttgatggctctgtttcaacaatagacttgggagcatcatctagccgtttcacaaactggggttcagttagcctctcactggatgcagagggcatttcaggctcaaatagcttttctttcattgagagcccaggcaaagggtatgcaattgttgatgagccattctcagaaattcctcggcaagggttcttgggggagatcaggtgcaattcagaatcttcagttctgagtgcccacgaatcatgccttagggcaccaaaccttatctcatacaagcccatgatagatcagttggagtgcacaacaaatctgattgatccctttgttgtctttgagaggggttccctgccacagacaaggaatgacaaaacctttgcagcttcaaaaggaaacaggggtgttcaagctttctctaagggctctgtacaagctgatctaactctgatgtttgacaattttgaggtggactttgtgggagcagccgtgtcttgtgatgctgccttcttaaatttgacagggtgctattcttgcaatgcaggggccagggtctgcctgtctatcacatccacaggaactggaaccctctctgcccacaataaggatgggtctctgcatatagttcttccatcagagaatggaacaaaagatcagtgtcagatactacacttcactgttcctgaagtagaggaagagtttatgtactcttgtgatggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttccttcttatatatcttggaagaacaggtctttctaaaatgtggcttgctgctactaagaaggcctcatag

SEQ ID NO: 4458 - RNA, 3480 nt, synthetic construct
  misc_feature 1..3480: note = derived and/or modified CDS sequence (wt) from RVFV(KEN/Gar-Msq/131B-04/06)__HM586972.1__NSm-Gn-Gc
  source 1..3480: mol_type = other RNA
atgattgaaggagcttgggattcatttagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacggaatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4459 - RNA, 3480 nt, synthetic construct
  misc_feature 1..3480: note = derived and/or modified CDS sequence (wt) from RVFV(2007001107)__EU574047.1__NSm-Gn-Gc
  source 1..3480: mol_type = other RNA
atgattgaaggagcttgggattcactcagagaggaggagatgccagaggagctctcctgctctgtatcaggcataagggaggttaagacctcaaaccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacggaatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggggcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4460 - RNA, 3480 nt, synthetic construct
  misc_feature 1..3480: note = derived and/or modified CDS sequence (wt) from RVFV(ANK-3837)__DQ380215.1__NSm-Gn-Gc
  source 1..3480: mol_type = other RNA
atgattgaaggagcttgggattcactcagagaggaggagatgccagaggagctctcctgttctatatcaggcataagggaggttaagacctcaagccaggagttatacagggcattaaaagccatcattgctgctgatggcttgaacaacatcacctgccatggtaaggatcctgaggacaagatttctctcataaagggtcctcctcataaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgagaaggggaaattcccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttaccttgataagcttgacctcaagactgaggagaatctgctaccagactcatttgtctgcttcgagcataagggacagtataaaggaaaattggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtagttgtgaagagagaactctctgccaagcccatccagagagttgagccttgcacaacttgtataaccaaatgtgagcctcatgggttggttgtccgatcaacagggttcaagatatcatctgcagttgcttgtgctagcggagtttgcgtcacaggatcgcagagtccttccaccgagattacactcaagtatccagggatatcccagtcctctggaggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgccccaaggaaagttctgaatccactaatgtggattacagccttcatcagatgggtgtataggaagatggttgccagagtggcagacaatattaatcaagtgaacagggagataggatggatggaaggaggtcagttggttctagggaaccctgcccctattcctcgtcatgttccaattccacgttatagcacatacctaatgctactactgattgtctcatatgcatcagcatgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggagaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctggagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgagtcatgccttagggcaccaaaccttatctcatacaagcccatgatagatcaattggagtgcacaacaaatctgattgacccctttgttgtatttgagaggggttctctgccacagacaaggaatgacaaaacctttgctgcttcaaaaggaaatagaggtgttcaagctttctctaagggctctgtgcaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctattggtgagggggactctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcttgtatgttgcattatcaattgggctctttttcctcctcatatatcttggaagaacaggcctctctaaaatgtggcttgctgctactaagaaggcctcatag

SEQ ID NO: 4461 - RNA, 3480 nt, synthetic construct
  misc_feature 1..3480: note = derived and/or modified CDS sequence (wt) from RVFV(Lunyo)__KU167026.1__NSm-Gn-Gc
  source 1..3480: mol_type = other RNA
atgattgaaggagcttgggattcactcagagaggaggagatgccagaagaactctcctgttctatatcaggcataagagaggttaaaacctcaagccaggaattatacagggcattaaaagccatcattgctgctgatggcttgaacaacatcacctgccatggtaaggatcctgaggacaagatttctctcataaagggtcctcctcacaaaaagcgggtggggatagttcggtgtgagagacgaagagacgctaagcaaatagggagagaaaccatggcagggattgcaatgacagtccttccagccttagcagtttttgctttggcacctgttgtttttgctgaagaccctcatctcagaaatagaccagggaaggggcacaactacattgacgggatgactcaggaggatgccacatgtaaacctgtgacatatgctggggcatgtagcagttttgatgtcttgcttgaaaagggaaaatttcccctcttccagtcgtatgctcatcatagaactctactggaggcagttcatgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaagactgcaacttttgtaggcagatgacaggtgctagcttgaagaaggggtcttatcccctccaggacctattttgtcagtcaagtgaggatgatggatcaaaattaaaaacaaaaatgaaaggggtctgcgaagttggggttcaagcactcaaaaagtgtgatggccaactcagcactgcacatgaggttgtgccctttgcagtgtttaagaactcaaagaaggtttatcttgataagcttgacctcaagactgaggaaaatctgctaccagactcatttgtctgcttcgagcacaagggacagtataaaggaacaatggtctctggtcagactaagagggagctcaaaagctttgatatctctcagtgtcccaagattggaggacatggtagcaagaagtgcactggggacgcagcattttgctctgcttatgagtgcactgctcaatatgccaatgcctattgctcacatgctaatggatcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccggtcaacagggttcaagatatcatctgcagttgcttgtgctagcggagtttgcgtcacaggatcgcagagtccttctaccgagattacactcaagtatccagggatatcccagtcctctgggggggacataggggttcacatggcacatgatgatcagtcagttagttccaaaatagtagctcactgccctccccaggacccgtgcctagtgcatggctgcatagtgtgtgctcatggcctgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcagatgggtgtataagaagatggttgccagagtggcagacaatatcaatcaagtgaacagggaaataggatggatggaaggaggtcagttggctctagggaaccctgcccctattcctcgtcatgctccaattccacgttatagcacatacctaatgctactattgattgtctcatatgcatcagcatgttcagaactgattcaggcaagctccagaatcaccacttgctccacagaaggtgtcaacaccaggtgtaggctgtctggcacagcattaatcagggcagggtcagttggggcagaggcttgtttgatgttaaagggggtcaaggaagaccaaaccaagttcttgaagataaaaactgtctcaagtgagctatcgtgcagggagggccagagctattggactggatcctttagccccaaatgtctgagctcaaggagatgccatcttgtcggggaatgtcatgtgaataggtgtctgtcttggagggacaatgaaacttcagcagaattttcatttgttggggaaagcacgactatgcgagagaataaatgttttgagcagtgtggaggatggggatgtgggtgtttcaatgtgaacccatcttgcttatttgtgcacacgtatctgcagtcagttagaaaagaggcccttagagttttcaactgtatcgattgggtgcataaactcactctagagattacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaaccttatttcatacaagcccatgatagatcagttggagtgcacaacaaatttgattgatccctttgttgtctttgagaggggttctctaccacagacaaggaatgacaaaacctttgcagcttcaaaaggaaataggggtgttcaagctttctctaagggctctgtacaagctgacctaactctgatgtttgacaattttgaggtggactttgtgggggcagccgtgtcttgtgatgccgccttcttaaatttgacaggttgctattcctgcaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaggggaccctgatagctattgatccatttgatgataggcgagaagcagggggggaatcaacagttgtgaatccaaaatctggatcttggaatttctttgactggttttctggactcatgagttggtttggagggccccttaagactatactccttatttgcctgtatgtagcattatcaattgggctctttttccttcttatatatcttggaagaacaggtctctctaaaatgtggcttgctgccactaagaaagcctcatag

SEQ ID NO: 4462 - RNA, 3480 nt, synthetic construct
  misc_feature 1..3480: note = derived and/or modified CDS sequence (wt) from RVFV(RVFBJ01/2016)__KX785331.1__NSm-Gn-Gc
  source 1..3480: mol_type = other RNA
atgattgaaggagcttgggattcactcagagaggaggagatgccagaagagctctcctgttccatatctggcataagggaggtcaagacctcaagccaggaattatacagggcattaaaagccatcattgctgctgatggcttgaacaacatcacctgccatggtaaggatcctgaggacaaaatttctctcataaagggtcctcctcacaagaagcgggtggggatagttcggtgtgagagacgaagggacgctaagcaaatagggagagaaaccatggcagggattgcaatgacagttcttcccgccttagcagtttttgctttggcacctgttgtttttgctgaggaccctcatctcagaaacagaccagggaagggacataactacattgacgggatgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgatccacctagctgtgatctccagagtgctcatgggaatccctgcatgaaagagaaactcgtgatgaagacacactgtccaaatgactaccagtcagctcattacctcaacaatgacgggaaaatggcttcagtcaagtgccctcctaagcatgagcttactgaggactgcaacttttgtaggcagatgacaggtgctagcttgaagaaggggtcttatcctctccaggacttattttgtcagtcaagtgaggatgatggatcaaaactaaagacaaaaatgaaaggggtctgcgaagtgggggttcaggcactcaaaaagtgtgatggccaactcagcactgcacatgaggttgtgccctttgcagtgtttaagaattcaaagaaggtttatcttgacaagcttgaccttaagactgaagaaaatctgctaccagactcatttgtctgctttgagcataagggacagtataaaggaacaatggactctggtcagactaagagggagctcaaaagctttgatatctctcagtgccccaagattgggggacatggtagcaagaagtgcactggggacgcagcattttgctctgcttatgagtgtactgctcaatatgccaatgcctattgttcacatgctaatgggtctgggattgtacagatacaagtatccggggtctggaagaagcctttatgtgtggggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgccagcggagtttgcgtcacaggatcgcagagcccttctactgagatcactctcaagtatccagggatatcccagtcctctgggggggatataggggttcacatggcacatgatgatcagtcagttagctccaaaatagtggctcactgccccccccaggacccgtgcctagtgcatggctgcatagtgtgtgctcatggcttgataaattaccagtgtcacactgctcttagtgcttttgttgttgtgttcgtattcagctctgttgcaataatttgtctggccattctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgcacccattcctcgtcatgctccgattccacgttatagcacatacctaatgctactattgattatctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttaatgttaaagggggtcaaggaagaccagaccaagttcttgaagataaaaactgtctcaagtgagctatcgtgcagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtggatgtttcaatgtgaacccatcttgcttatttgtgcacacgtatctgcaatcagttagaaaagaggctcttagagtttttaactgtattgattgggtgcataaactcactctagagatcacagactttgatggctctgtttcaacaatagacttgggagcatcatctagccgtttcacaaactggggctcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttctgtcctgagtgctcatgagtcatgccttagggcaccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaaaggctctgtacaggctgatctaactctgatgtttgacaattttgaggtggactttgtgggagcagccgtgtcttgtgatgccgccttcttaaatttgacaggttgctattcctgcaatgctggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagttcatgtactcttgtgatggagatgagcgacctttgttggtgaaggggaccctaatagctattgatccatttgatgataggcgagaagcagggggagaatcaacagttgtgaatccaaaatctggatcttggaacttctttgactggttttctggacttatgagttggtttggaggacctcttaagactatactcctaatttgcctgtatgtagcattatcaattgggctctttttccttcttatatatcttggaagaacaggtctctctaaaatgtggcttgctgccactaagaaagcctcatag

SEQ ID NO: 4463 - RNA, 3480 nt, synthetic construct
  misc_feature 1..3480: note = derived and/or modified CDS sequence (wt) from RVFV(Ken 199800523)__KU978777.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatactaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggccagaccaagagggagctcaaaagctttgatatctctcagtgccccaagattggagggcacggtagtaagaagtgcactggggacgcagcattttgctctgcttatgaatgcactgctcagtatgccaatgccttttgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgaacctcatggattggttgtccgatcaacagggttcaagatatcatctgcagttgcttgtgctagcggagtttgcgtcacagggtcgcagagtccttctactgagattacactcaagtatccagggatatcccagtcctctgggggggacataggggttcacatggcacatgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccattaatgtggattacagccttcatcagatgggtgtataagaagatggttgctagagtggcggacaatattaatcaagtgaacagggaaataggatggatggaaggaggtcagttggttctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgaatgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgttattcctgcaatgcaggggccagagtctgcctgtctatcacatccacaggaactggaactctctctgcccacaataaggaggggtctctgcatatagttctcccatcagagaatgggacaaaagatcagtgtcagatactacatttcactgtgcctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4464 - RNA, 3480 nt, synthetic construct
  misc_feature 1..3480: note = derived and/or modified CDS sequence (wt) from RVFV__JQ068143.1__NSm-Gn-Gc
  source 1..3480: mol_type = other RNA
atgattgaaggagcctgggattcactcagagaggaggagatgccagaagagctctcctgttccatatctggcataagggaggttaagacctctagccaggaattatacagggcattaaaagccatcattgctgctgatggcttgaacaacatcacctgccatggtaaggatcctgaggacaagatttccctcataaagggtcctcctcacaagaagcgggtggggatagttcggtgtgagagacgaagggacgctaagcaaatagggagagaaaccatggcagggattgcaatgacagtccttcccgccttagcagtttttgctttggcacctgttgtttttgctgaggaccctcatctcagaaacagaccagggaagggacacaactacattgacgggatgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgacccacctagctgtgatcttcagagtgctcatgggaacccctgcatgaaagagaaactcgtgatgaagacacactgtccaaatgactaccagtcagctcattatctcaacaatgacgggaaaatggcttcagtcaagtgccctcctaagtatgagctcactgaggactgcaacttttgtaggcagatgacaggtgctagcttgaagaaggggtcttatcctctccaggacttattttgtcagtcaagtgaggatgatgggtcaaaattaaagacaaaaatgaaaggggtctgcgaagtgggggttcaagcactcaaaaagtgtgatggccaactcagcactgcacatgaggttgtgccctttgcagtgtttaagaactcaaagaaggtttatcttgacaagcttgacctcaagactgaagaaaatctgctaccagactcatttgtctgctttgagcataaaggacagtataaaggaacaatagactctggtcagactaagagagagctcaaaagctttgatatctctcagtgccccaagattggaggacatggtagcaagaagtgcactggggacgcagcattttgctctgcttatgagtgtactgctcagtatgccaatgcctattgttcacatgctaatgggtctgggattgtacagatacaagtgtccggggtctggaagaagcctctgtgtgtaggatatgagagagtggttgtgaagagagaactctctgccaagcccatccagagagttgagccttgcacaacttgcataaccaaatgtgagcctcatggattggttgtccgatcaacagggtttaagatatcatctgcagttgcttgtgctagcggggtttgcgtcacaggatcgcagagcccttctactgagatcactcttaagtatccagggatatcccaatcctctgggggggacataggagttcacatggcacatgatgatcagtcagttagctccaaaatagtggctcactgccccccccaggacccgtgcctagtgcatggctgcatagtgtgtgctcatggcttgataaattaccagtgtcacactgctctcagtgcttttgttgttgtattcgtattcagctctgttgcaataatttgtctggccatcctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgctcctattcctcgtcatgctccaattccacgttatagcacgtatctaatgctactattgattatctcatatgcatcagcatgttcagaactgattcaggcaagctccagaatcactacttgctccacagaaggtgtcaacaccaagtgtaggctgtctggcacagcattaatcagggcagggtcagttggggcagaggcttgtttaatgttaaagggggtcaaggaagaccagaccaagttcttgaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacctcagcagaattttcatttgttggggaaagcacgaccatgcgagagaataagtgttttgagcagtgtggaggatggggatgtggatgtttcaatgtgaacccatcttgcttatttgtgcacacgtatctgcagtcagttagaaaagaggcccttagagtttttaactgtattgattgggtgcataaactcactctagagatcacagactttgatggctctgtttcaacaatagacttgggggcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggagagatcaggtgcaattcagaatcttctgtcctgagtgctcatgaatcatgccttagggctccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaagggctctgtacaagctgatctaactctgatgtttgacaattttgaggtggactttgtgggggcagccgtgtcttgtgatgccgccttcttaaatttgacaggttgctattcctgcaatgctggagccagagtctgcctgtctatcacatccacaggaactggaactctttctgcccacaataaggatgggtctctgcacatagttcttccatcagagaatggaacaaaagatcagtgtcagatactacacttcactgtacctgaggtggaggaggagtttatgtactcttgtgatggagatgagcggcctttgttggtgaaggggaccctaatagctattgatccatttgatgataggcgagaagcagggggagaatcaacagttgtgaatccaaaatctggatcttggaacttctttgactggttttctggacttatgagttggtttggagggcctcttaagactatactcctaatttgcctgtatgtagcattatcaattgggctctttttccttcttatatatctcggaagaacaggtctctctaaaatgtggcttgctgccactaagaaagcctcatag

SEQ ID NO: 4465 - RNA, 3480 nt, synthetic construct
  misc_feature 1..3480: note = derived and/or modified CDS sequence (wt) from RVFV(200803169)__JF311384.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgacccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgacatctctcagtgccccaagattggagggcatggtagtaagaagtgcactggggacgcagcattctgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggtagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagattcctcggcaagggttcttgggggaggtcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4466 - RNA, 3480 nt, synthetic construct
  misc_feature 1..3480: note = derived and/or modified CDS sequence (wt) from RVFV(2007002445)__EU574037.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactatattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctatacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4467 - RNA, 3480 nt, synthetic construct
  misc_feature 1..3480: note = derived and/or modified CDS sequence (wt) from RVFV(Hv-B375)__DQ380218.1__NSm-Gn-Gc
  source 1..3480: mol_type = other RNA
atgattgaaggagcttgggattcactcagagagggggagatgccagaggagctctcctgttctatatcaggcataagggaggttaagacctcaagccaggagttatacagggcattaaaagccatcattgctgctgatggcttgaacaacatcacctgccatggtaaggatcctgaggacaagatttctctcataaagggtcctcctcataaaaagcgggtggggatagttcggtgtgagagacgaagagatgctaagcaaatagggagagaaaccatggcagggattgcaatgacagtccttccagccttggcagtttttgctttggcacctgttgtttttgctgaggacccccatctcagaaacagaccagggaaggggcacaactacattgacgggatgacccaggaggatgccacatgcaaacctgtgacatatgctggggcatgtagcagttttgatgtcttgcttgagaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagaatgagctcactgaggactgcaacttttgtaggcagatgacaggtgctagcctaaagaaggggtcttatcctctccaagacttattttgccagtcaagtgaggatgatggatcaaaattaaaaacaaaaatgaaaggggtctgcgaagtgggggtccaagcactcaaaaagtgtgatggccaactcagcaccgcacatgaggttgtgccctttgcagtgttcaagaactcaaagaaggtttacctcgataagcttgacctcaagactgaggagaatctgctgccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtgtcaggggtctggaagaagcctttatgtgtagggtatgagagagtggttgtgaagagagaactctctgccaagcccatccagagagttgagccttgcacaacttgtataaccaaatgtgagcctcatggtttggttgtccgatcaacagggttcaagatatcatctgcagttgcttgtgctagcggagtttgcgtcacaggatcacagagcccttctaccgagattacactcaagtatccagggatatcccagtcctctgggggggacataggggttcacatggcacacgatgatcagtcagttagctccaaaatagtagctcactgccctccccaggacccatgcttagtgcacggctgcatagtgtgtgctcatggcctgataaattaccagtgtcacactgccctcagtgcctttgttgttgtgtttgtattcagttctattgcaataatttgtttagccattctttatagggtgctcaagtgcttaaagattgccccaaggaaagttctgaatccactaatgtggatcacagccttcatcagatgggtgtataagaagatggttgccagagtggcagacaatattaatcaagtgaacagggagataggatggatggaaggaggtcagttggttctagggaaccctgctcctattcctcgtcatgccccaattccacgttatagcacatacctaatgctactgctaattgtctcatatgcatcagcatgttcagaactaattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagtacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaactcagagtcctcagtcctgagtgctcatgaatcatgccttagggcaccaaaccttatctcatacaagcccatgatagatcaattggagtgcacaacaaatctgattgatccctttgttgtatttgagaggggttctctgccacagacaaggaatgacaaaacctttgcagcttcaaaaggaaatagaggtgttcaagctttctctaagggctctgtgcaagctgatctaactctgatgtttgacaattttgaggtggactttgtgggagcagctgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcaatgccagatactacacttcactgtacctgaagtagaggaggagtttatgtactcttgtgatggagatgagcggcctctattagtgaaagggaccctgatagctattgatccatttgatgataggcgggaagcagggggagaatcaacagttgtgaatccaaaatctggatcttggaatttctttgactggttttctggactcatgagttggtttggagggcctctcaaaactatactcctcatttgcctgtatgttgcattatcaattgggctctttttcctcctcatatatcttggaagaacagggctctctaaaatgtggcttgctgctactaagaaggcctcatag

SEQ ID NO: 4468 - RNA, 3480 nt, synthetic construct
  misc_feature 1..3480: note = derived and/or modified CDS sequence (wt) from RVFV(clone 13)__DQ380213.1__NSm-Gn-Gc
  source 1..3480: mol_type = other RNA
atgattgaaggagcttgggattcactcagagaggaggagatgccagaggagctctcctgttctatatcaggcataagagaggttaagacctcaagccaggagttatacagggcattaaaagccatcattgctgctgatggcttgaacaacatcacctgccatggtaaggatcctgaggataagatttctctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcccctcttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagcatgagctcacagaggactgcaacttttgtaggcagatgacaggtgctagcctgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcacaagggacagtataagggaacaatggactctggtcagactaagagggagctcaaaagctttgatatttctcagtgccccaagattggaggacatggtagtaagaagtgcactggggacgcagcattttgctctgcttatgagtgcactgctcagtatgccaatgcttattgttcacatgctaatgggtcagggattgtgcagatacaagtatcaggggtctggaagaagcctttatgtgtagggtatgagagagtggttgtgaagagagaactctctgccaagcccatccagagggttgagccttgcacaacttgtataaccaaatgtgagcctcatggattggttgtccgatcaacagggttcaagatatcatctgcagttgcttgtgctagcggagtttgcgtcacaggatcgcagaatccttccaccgagatcacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgttcgtgttcagttctattgcaataatttgtttagctattctttatagggtgctcaagtgcctaaagattgccccaaggaaagttctgaatccactaatgtggattacagccttcatcagatgggtgtataagaagatggttgccagagtggcagacaatattaatcaagtgaatagggaaataggatggatggaaggaggtcagttggtcctagggaaccctgcccctattcctcgccatgccccaattccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtctgatgttgaagggggtcaaggacgatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactaacactagagatcacagactttgatggctctgtttcaacaatagacctaggagcatcatctagccgtttcacaaactggggttcagtcagcctctcactggacgcagagggcatttcaggctcaaatagcttttctttcattgagagcccaggcaaagggtatgcaattgttgatgagccattctcagaaattcctcggcaagggttcctgggggagatcaggtgcaattcagagtcctcagtcctgagtgctcatgaatcatgccttagggcaccaaaccttatctcatacaagcccatgatagaccaattggagtgcacaacgaatctgattgatccatttgttgtctttgagaggggttctctgccacagacaaggaatgaaaaaacctttgcagcttcaaaaggaaatagaggtgtccaagccttctctaagggctctgtacaagctgatctaactctgatgtttgacaattttgaggtggattttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcaatgccagatactacacttcactgtacctgaggtagaggaggagtttatgtactcttgtgacggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactccttatttgcctgtatgttgcattatcaattgggctctttttcctcctcatatatcttggaagaacaggcctctctaaaatgtggcttgctgctactaagaaggcctcatag

SEQ ID NO: 4469 - RNA, 3480 nt, synthetic construct
  misc_feature 1..3480: note = derived and/or modified CDS sequence (wt) from RVFV(Kenya 57 (Rintoul))__DQ380192.1__NSm-Gn-Gc
  source 1..3480: mol_type = other RNA
atgattgaaggagcttgggattcactcagagaggaggagatgccagaggagctctcctgttccatatcaggcataagggaggttaagacctcaagccaggaattacacagggcattaaaagccatcattgctgctgatggcttgaacaacatcacctgccatggtaaggatcctgaggacaagatttctctcataaagggtcctcctcacaaaaagcgggtgggggtagttcggtgtgagagacgaagagacgctaagcaaatagggagagagaccatggcagggattgcaatgacagtccttccagccttagcagtttttgctttggcacctgttgtttttgctgaagaccctcatctcagaaacagaccagggaagggacacaactacattgacgggatgactcaggaggatgccacatgtaaacctgtgacatatgctggggcatgtagcagttttgatgtcttgctcgaaaagggaaaatttcccctcttccagtcgtatgctcatcatagaactctattagaggcagttcacgacaccatcattgcaaaggctgatccacctagctgtgaccttcagagtgctcatgggaatccctgcatgaaagagaaactcgtaatgaagacacactgtccaaatgactaccagtcagctcattacctcaacaatgacgggaaaatggcttcagtcaagtgccctcctaagtatgagctcactgaggactgcaacttttgtaggcagatgacaggtgctagcttgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgacaagcttgacctcaagactgaggaaaatctgctaccagactcatttgtctgcttcgagcataagggacagtacaaaggaacaatggactctggtcagattaagagggagctcaaaagctttgatatctctcagtgccccaagattggaggacatggtagcaagaagtgcactggggacgcagcattttgctctgcttatgagtgtactgctcaatacgccaatgcctattgttcacatgctaatgggtcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctactgagattacactcaagtatccagggatatcccagtcctctgggggagacataggggttcacatggcacatgatgatcagtcagttagctccaaaatagtagctcactgccccccccaggacccgtgcctagtgcatggctgcatagtgtgtgctcatggcttgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcagatgggtgtataagaagatggttgccagagtggcagacaatatcaatcaagtgaacagggaaataggatggatggaaggaggccagttggttctagggaaccctgcccctattcctcgtcatgctccaattccacgttatagcacatacctaatgctgctattgattgtctcatatgcatcagcatgttcagaactaattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccagaccaagttcttgaagataaaaactgtctcaagtgagctatcgtgtagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtattgattgggtgcataaactcactctagagatcacagactttgatggctctgtttcaacagtagacttgggagcatcatctagccgtttcacaaactggggttcagttagcctctcactggacgcagagggcatttcaggctcaaatagcttctctttcattgagagcccaggcaaagggtatgcaattgttgatgagccattctcagaaatttctcggcaagggttcttgggagagatcaggtgcaattcagaatcttcagtcctgagtgctcatgaatcatgccttagggcaccaaaccttatctcatacaaacccatgatagatcagttggagtgcacaacaaatctgattgatccctttgttgtctttgagaggggttctctgcctcagacaaggaatgacaaaacctttgcagcttcaaaaggaaataggggtgttcaagctttctctaagggctctgtacaagctgatctaactctgatgtttgacaattttgaggtggactttgtgggagcagccgtgtcttgtgatgccgccttcttaaacttgacaggttgctattcctgcaatgcaggggccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaggggaccctgatagctattgatccatttgatgataggcgagaagcagggggggaatcaacagttgtgaatccaaaatctggatcttggaatttctttgactggttttctggacttatgagttggtttggagggcctcttaagactatactcctaatttgcctgtatgtagcattatcaattgggctctttttccttcttatatatcttggaagaacaggtctctccaaaatgtggcttgctgccactaagaaagcttcatag

SEQ ID NO: 4470 - RNA, 3480 nt, synthetic construct
  misc_feature 1..3480: note = derived and/or modified CDS sequence (wt) from RVFV(2007001292)__EU574046.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacggaatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactggatcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatctctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4471 - RNA, 3480 nt, synthetic construct
  misc_feature 1..3480: note = derived and/or modified CDS sequence (wt) from RVFV(2007001811)__EU574040.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgagtggggatagtccggtgtgagagacgaagagatgctaagcaaatagggagagaaaccatggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctgctagaggcagttcacgacaccatcattgcaaaggctgatccacctagctgtgacctccagagtgctcatgggaatccctgtatgaaagagaaacttgtgatgaagacacattgtcctaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagcatgttcagaactgattcaggcaagctccagaatcaccacttgctccacagagggtgtcaacaccaagtgtagactgtctggcacagcattgatcagggcagggtcagttggggcggaagcttgtttgatgttgaagggggtcaaggaagatcaaaccaagttcttaatgataaaaactgtctcaagtgagctatcgtgcagggagggccagagctattggactgggtcctttagccccaagtgcctgagctcaagaagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctcatag

SEQ ID NO: 4472 - RNA, 3480 nt, synthetic construct
  misc_feature 1..3480: note = derived and/or modified CDS sequence (wt) from RVFV(ANK-6087)__DQ380216.1__NSm-Gn-Gc
  source 1..3480: mol_type = other RNA
atgattgaaggagcttgggattcactcagagaggaggagatgccagaggagctctcctgttctatatcaggcataagggaggttaagacctcaagccaggagttatacagggcattaaaagccatcattgctgctgatggcttgaacaacatcacctgccatggtaaggatcctgaggacaagatttctctcataaagggtcctcctcataaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgagaaggggaaattcccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttaccttgataagcttgacctcaagactgaggagaatctgctaccagactcatttgtctgcttcgagcataagggacagtataaaggaaaattggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtagttgtgaagagagaactctctgccaagcccatccagagagttgagccttgcacaacttgtataaccaaatgtgagcctcatgggttggttgtccgatcaacagggttcaagatatcatctgcagttgcttgtgctagcggagtttgcgtcacaggatcgcagagtccttccaccgagattacactcaagtatccagggatatcccagtcctctggaggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgccccaaggaaagttctgaatccactaatgtggattacagccttcatcagatgggtgtataggaagatggttgccagagtggcagacaatattaatcaagtgaacagggagataggatggatggaaggaggtcagttggttctagggaaccctgcccctattcctcgtcatgttccaattccacgttatagcacatacctaatgctactactgattgtctcatatgcatcagcatgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaaaataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggagaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctggagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgagtcatgccttagggcaccaaaccttatctcatacaagcccatgatagatcaattggagtgctcaacaaatctgattgacccctttgttgtatttaagaggggttctctgccacagacaaggaatgacaaaacctttgctgcttcaaaaggaaatagaggtgttcaagctttctctaagggctctgtgcaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctattggtgagggggactctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcttgtatgttgcattatcaattgggctctttttcctcctcatatatcttggaagaacaggcctctctaaaatgtggcttgctgctactaagaaggcctcatag

SEQ ID NO: 4473 - RNA, 3480 nt, synthetic construct
  misc_feature 1..3480: note = derived and/or modified CDS sequence (wt) from RVFV(2007000234)__JF326191.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaataaggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtaccagaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4474 - RNA, 3480 nt, synthetic construct
  misc_feature 1..3480: note = derived and/or modified CDS sequence (wt) from RVFV(SA-75)__DQ380189.1__NSm-Gn-Gc
  source 1..3480: mol_type = other RNA
atgattgaaggagcttgggattcactcagagaggaggagatgccagaagagctctcctgttccatatcaggcataagggaggtcaaaacctcaagccaggaattgtatagggcattaaaagccatcattgctgctgatggcttgaacaacatcacctgccatggtaaggatcctgaggataagatttctctcgtaaagggtcctcctcacaaaaagcgggtggggatagttcggtgtgagagacgaagagacgctaagcaaataggaagagaaaccatggcaaggattgcaatgacagtccttccagccttagcagtttttgctttggcacctgttgtttttgctgaagaccctcatctcagaaacagaccagggaaggggcacaactacattgacgggatgactcaggaggacgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccctgcatgaaggagaaactcgtgatgaagacacactgtccaaatgactaccagtcagctcattacctcaacaatgacgggaaaatggcttcagtcaagtgccctcctaaatatgagctcactgaggactgcaatttttgcaggcagatgacaggtgctagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctcaaaagctttgatatctctcagtgccccaagattggaggacatggtagcaagaagtgcactggggacgcagctttttgctctgcttatgagtgcactgctcaatacgccaatgcttattgttcacatgctaatgggtcaggagttgtacagatacaagtatccggggtctggaagaagcctttgtgtgtcgggtatgagagggtggttgtgaagagagaactctctgctaagcccatccagagagttgagccttgcacaacttgtataaccaaatgtgagcctcacggattggttgtccgatcaacaggtttcaagatatcatctgcagttgcttgtgctagcggagtttgcgttacaggatcgcagagcccttctaccgagattacactcaagtatccagggatatcccagtcctctgggggggacataggggttcacatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctgaatccactaatgtggattactgttttcatcagatgggtgtataagaagatggttgccagagtagcagacaatatcaatcaggtgaacagggaaataggatggatggaaggaggccagctggctctagggaaccctgcccctattcctcgtcatgctccaattccacgttatagcacatacctaatgctactattgattgtctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagagacaatgaaacctcagcagaattttcatttgttggggaaagcacgaccatgcgggagaacaagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgatggctctgtttcaacaatagacctgggagcatcatctagccgtttcacaaactggggttcagttagcctctcactggacgcagagggcatttcaggctcaaacagcttttccttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaatcttatttcatacaagcccatgatagatcagttggagtgcacaacaaatctgattgacccctttgttgtctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatggatctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttccttcttatatatcttggaagaacaggcctctctaaaatgtggcttgctgccaccaagaaagcctcatag

SEQ ID NO: 4475 - RNA, 3480 nt, synthetic construct
  misc_feature 1..3480: note = derived and/or modified CDS sequence (wt) from RVFV(KEN07-KUR340)__EF460404.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctcttataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgacccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgacatctctcagtgccccaagattggagggcatggtagtaagaagtgcactggggacgcagcattctgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttataggatgctcaagtgcttaaagattgccccaaggatagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcgtctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4476 - RNA, 3480 nt, synthetic construct
  misc_feature 1..3480: note = derived and/or modified CDS sequence (wt) from RVFV(35/74)__JF784387.1__NSm-Gn-Gc
  source 1..3480: mol_type = other RNA
atgattgaaggagcttgggattcactcagagaggaggagatgccagaagagctctcctgttccatatcaggcataagggaggtcaaaacctcaagccaggaattgtatagggcattaaaagccatcattgctgctgatggcttgaacaacatcacctgccatggtaaggatcctgaggataagatttctctcgtaaagggtcctcctcacaaaaagcgggtggggatagttcggtgtgagagacgaagagacgctaagcaaataggaagagaaaccatggcagggattgcaatgacagtccttccagccttagcagtttttgctttggcacctgttgtttttgctgaagaccctcatctcagaaacagaccagggaaggggcacaactacattgacgggatgactcaggaggacgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccctgcatgaaggagaaactcgtgatgaagacacactgtccaaatgactaccagtcagctcattacctcaacaatgacgggaaaatggcttcagtcaagtgccctcctaaatatgagctcactgaggactgcaatttttgcaggcagatgacaggtgctagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctcaaaagctttgatatctctcagtgccccaagattggaggacatggtagcaagaagtgcactggggacgcagctttttgctctgcttatgagtgcactgctcaatacgccaatgcttattgttcacatgctaatgggtcaggagttgtacagatacaagtatccggggtctggaagaagcctttgtgtgtcgggtatgagagggtggttgtgaagagagaactctctgctaagcccatccagagagttgagccttgcacaacttgtataaccaaatgtgagcctcacggattggttgtccgatcaacaggtttcaagatatcatctgcagttgcttgtgctagcggagtttgcgttacaggatcgcagagcccttctaccgagattacactcaagtatccagggatatcccagtcctctgggggggacataggggttcacatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctggatccactaatgtggattactgttttcatcagatgggtgtataagaagatggttgccagagtagcagacaatatcaatcaggtgaacagggaaataggatggatggaaggaggccagctggctctagggaaccctgcccctattcctcgtcatgctccaattccacgttatagcacatacctaatgctactattgattgtctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagagacaatgaaacctcagcagaattttcatttgttggggaaagcacgaccatgcgggagaacaagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgatggctctgtttcaacaatagacctgggagcatcatctagccgtttcacaaactggggttcagttagcctctcactggacgcagagggcatttcaggctcaaacagcttttccttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaatcttatttcatacaagcccatgatagatcagttggagtgcacaacaaatctgattgatccctttgttgtctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatggatctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttccttcttatatatcttggaagaacaggcctctctaaaatgtggcttgctgccaccaagaaagcctcatag

SEQ ID NO: 4477 - RNA, 3480 nt, synthetic construct
  misc_feature 1..3480: note = derived and/or modified CDS sequence (wt) from RVFV(200803167)__JF311382.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacctccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattgcactcaagtatccagggatatcccagtcctctgggggggatataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagggaaataggatggatggaagggggtcagttggttctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgtttcgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatgctcctcatttgcctgtatgttgcattatcaattgggctcttcttcctccttatatatcttggaagaacaggcctctctaaaatgtggcttgccgctactaagaaggcctcatag

SEQ ID NO: 4478 - RNA, 3480 nt, synthetic construct
  misc_feature 1..3480: note = derived and/or modified CDS sequence (wt) from RVFV(25010-24)__KM210509.1__NSm-Gn-Gc
  source 1..3480: mol_type = other RNA
atgattgagagagcttgggattcactcagagaggaggagatgccagaagagctctcttgttccatatcaggcataagggaggttaagacctcaagccaggaattatacagggcattaaaagctatcattgctgctgatggcttgaacaacatcacctgccatggtaaggatcctgaggacaagatttctctcataaagggtcctcctcacaagaagcgagtggggatagttcggtgtgagagacgaagagacgctaagcaagtagggagagaaaccatggcagggattgcaatgacagtccttccagccttagcagtttttgctttggcacctgttgtctttgccgaagaccctcatcttagaaacaggccaggaaagggacacaactacattgacgggatgactcaggaggatgccacatgtaaacctgtgacatatgctggggcatgtagcagttttgatgtcttgctcgaaaagggaaaatttcccctcttccagtcatacgctcatcatagaactctactagaggccgtccacgacaccattattgcaaaggctgatccacctagctgtgaccttcagagtgctcatgggaatccctgcatgaaggagaaactcgtgatgaagacacactgtccaaatgactaccagtcagctcattaccttaacaatgacgggaaaatggcctcagtcaagtgccctcctaagtatgagctcactgaggactgcaacttttgtaggcagatgacaggtgctagcctgaagaaagggtcttatcctctccaggacttattttgtcagtcaagtgaggatgatgggtcaaaattaaaaacaaaaatgaaaggggtctgcgaagtgggagttcaagcactcaaaaagtgtgatggccaactcagcactgcacatgaggttgtgccctttgcagtatttaagaactcaaagaaggtttatcttgacaagcttgacctcaagactgaggaaaatctgctaccagactcatttgtctgcttcgagcataaggggcagtataaaggaacaatggactctggtcagacaaagagggagctcaaaagctttgatatctctcagtgtcccaagattggagggcatggtagcaagaaatgtactggggacgcagcattctgctctgcttatgagtgcactgctcaatacgccaatgcctattgttcacatgctaatgggtcaggaattgtacagatacaagtatccggggtctggaagaagcctttgtgtgtagggtatgagagagtggttgtgaagagagagctctctgccaagcccatccagagagttgagccttgcacaacttgtataaccaaatgtgagcctcatggattaattgtccgatcaacagggttcaagatatcatctgcagttgcttgtgctagcggagtttgcgtcacaggatcgcagagcccgtctactgagatcacactcaagtacccagggatatcccagtcctctgggggggacataggggttcacatggcacatgatgatcagtcagttagctccaaaatagtagctcactgccccccccaggacccgtgcctagtgcatggctgcatagtgtgtgctcatggcttgataaattaccagtgtcacactgctctcagtgcctttgtcgttgtgttcgtgttcagctctgttgcaataatttgtttggctattctttataaggtgctcaagtgcctaaaaattgccccaaagaaagttctaaatccactgatgtggattactgctttcatcagatgggtgtataagaagatggttgccagagtggcagacaatatcaatcaagtgaacagggaaataggatggatggaaggaggccagttagctctagggaatcctgctcctatccctcgtcatgctccaattccacgttatagcacatacctaatgctactattgattgtctcatatgcatcagcatgttcagaactgattcaggccagctccagaatcactacttgctccacagaaggtgttaacactaagtgtaggctgtctggcacagcattgatcagggcaggatcagttggagcagaagcttgtctgatgttaaagggggtcaaggatgaccaaaccaagttcctgaagataaaaactgtctcaagtgagctatcgtgcagggagggccagagctattggactgggtccttcagccccaaatgtctgagctcaaggaggtgccatcttgtcggggaatgtcatgtgaataggtgtctgtcttggagggacaatgagacttcagcagaattttcatttgttggggaaagcacgaccatgcgagagaacaagtgttttgagcagtgtggaggatggggatgtgggtgtttcaacgtaaacccatcttgcttgtttgtgcacacgtatctacagtcagtcagaaaagaggcccttagagtttttaactgcattgattgggtgcataaacttactctagagatcacagactttgatggctctgtttcaacaatagacttgggagcttcatctagccgtttcacaaactggggttcagttagcctctcactggacgcagagggcatttcaggctcaaatagcttttctttcattgagagcccaggcaaagggtatgcaattgttgatgagccattctcagaaattcctcggcaaggattcttaggagagatcaggtgcaattcagaatcttcagttctgagtgctcatgaatcatgccttagggcgccaaaccttatctcatacaaaccaatgatagatcagttggagtgcacaacaaatctaattgatccttttgtagtctttgagaggggttccctgccacaaacaaggaatgacaaaacctttgcagcttcaaaagggaataggggtgttcaagctttctctaagggctctgtacaagctgatctaactctgatgtttgacaattttgaggtggacttcgtgggagcagccgtgtcttgtgatgccgccttcttgaatttgacaggttgctattcatgcaatgcaggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaagggaccctgatagctattgatccatttgatgataggcgagaagcagggggggaatcaacagttgtgaatccaaaatctggatcttggaatttctttgactggttttctggactcatgagttggtttggagggcctctcaagactatactcctaatttgcctgtatgtagcattatcaattgggctctttttccttcttatatatcttgggagaacaggtctctctaaaatgtggcttgctgctactaagaaggcctcatag

SEQ ID NO: 4479 - RNA, 3480 nt, synthetic construct
  misc_feature 1..3480: note = derived and/or modified CDS sequence (wt) from RVFV(Sudan 2V-2007)__JQ820490.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaatatcacttgccatggtaagaatcctgaggacaagatttctctcataaagggtcctcctcacaaaaagcgagtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgacctccagagtgctcatgggaatccctgtatgaaagagaaacttgtgatgaagacacattgtccaaatgactaccagtcagctcattacctcaacaatgacgggaaaatggcctcagtcaagtgcccacctaagtatgagctcactgaggactgcaacttttgtagacagatgacaggtgctagcctgaagaaggggtcttatcctctccaagacttattttgtcagtcgagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtctatcttgataagcttgacctcaagactgaggagaatctgctaccagactcatttgtctgcttcgagcataagggacagtataaaggaacaatggactctggtcagaccaagagggagctcaagagctttgatatctctcagtgccccaagattggagggcatggtagtaagaagtgcactggggatgcagcattttgctctgcttatgaatgcactgctcagtatgccaatgcctattgttcacatgctaatgggtcagggattgtgcagattcaagtatcaggggtctggaagaaacctttgtgtgtagggtatgagagagtggttgtgaagagagaactctctgccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggatataggggttcacatggcacacgatgatcagtcagttagctccaaaatagtagctcactgccccccccaggacccgtgctcagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccctgcccctattcctcgtcatgccccaatcccacgttatagcacatacctaatgctactattgattgtctcacatgcatcagcatgttcagaacttattcaggcaagctccagaatcaccacttgctccacagagggtgtcaacaccaagtgtagactgtctggcacagcattgatcagggcagggtcagttggggcggaggcttgtttgatgttgaagggggtcaaggaagatcaaactaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtaaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggtttttgggggagatcaggtgcaattcagagtcctcagtcctaagtgctcatgaatcatgccttagggcgccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaagacgggtctctgcatatagttctcccatcagagaatgggacaaaagatcagtgtcagatactacattttactgtacctgaagtagaagaggagtttatgtactcttgtgatggagatgagcggcctctgttagtaaaagggaccctgatggctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4480 - RNA, 3480 nt, synthetic construct
  misc_feature 1..3480: note = derived and/or modified CDS sequence (wt) from RVFV(SAUDI 200010901)__KU978778.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgggagacgaagagatactaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcctcttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggagttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggccagaccaagagggagctcaaaagctttgatatctctcagtgccccaagattggagggcatggtagtaagaagtgcactggggacgcagcattttgctctgcttatgaatgcactgctcagtatgccaatgccttttgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgaacctcatggattggttgtccgatcaacagggttcaagatatcatctgcagttgcttgtgctagcggagtttgcgtcacagggtcgcagagtccttctactgagattacactcaagtatccagggatatcccagtcctctgggggggacataggggttcacatggcacatgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccattaatgtggattacagccttcatcagatgggtgtataagaagatggttgctagagtggcggacaatattaatcaagtgaacagggaaataggatggatggaaggaggtcagttggttctagggaaccctgcccctattcctcgtcatgccccaatcccacgttatagcacatacctaatgctgctattgattatctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggagtcaaggaagatcaaaccaagttcttaaagataaaaactgtctctagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgttattcctgcaatgcaggggccagagtctgcctgtctatcacatccacaggaactggaactctctctgcccacaataaggacgggtctctgcatatagttctcccatcagagaatgggacaaaagatcagtgtcagatactacatttcactgtgcctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4481 - RNA, 3480 nt, synthetic construct
  misc_feature 1..3480: note = derived and/or modified CDS sequence (wt) from RVFV(2373/74)__DQ380194.1__NSm-Gn-Gc
  source 1..3480: mol_type = other RNA
atgattgaaggagcttgggattcactcagagaggaggagatgccagaagagctctcctgttccatatcaggcataagagaggttaagacctcaagccaggaattatacagggcactaaaagccatcattgctgctgatggcttgaacaacatcacctgctatggtaaggatcctgaggacaagatttctctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagaccctcatctcagaaacagaccagggaaggggcacaactacattgacgggatgactcaggaggatgccacatgtaaacctgtgacatatgctggggcatgtagcagttttgatgtcttgctcgaaaagggaaaattccccctcttccagtcatatgctcatcatagaactctactagaggcagttcacgacaccatcattgcaaaggctgacccacctagctgtgacctccagagtgctcatgggaatccctgcatgaaagagaaactcgtgatgaagacacactgcccaaatgactaccagtcagctcattacctcaacaatgacgggaaaatggcttcagtcaagtgccctcctaagtatgagctcactgaggactgcaacttttgtaggcagatgacaggtgctagcttgaagaaggggtcttatcctctccaggacttgttctgtcaatcaagtgaggatgatggatcaaaattaaaaacaaaaatgaaaggggtctgcgaagtgggggttcaagcactcaaaaagtgtgatggccaactcagcactgcacatgaggttgtgccatttgcagtgtttaaaaactcaaagaaggtttatcttgacaagcttgacctcaagactgaggaaaatctgctaccagactcatttgtctgcttcgagcataagggacagtataaagggacaatggactctggtcagactaagagggagctcaaaagttttgatatctctcagtgccccaagattggaggacatggtagcaagaagtgcactggggacgcagcattttgctctgcttatgagtgcactgctcaatacgccaatgcctattgttcacatgctaatgggtcaggaattgtacagatacaagtatccggggtctggaagaagcctttatgtgtaggatatgagagagtggttgtgaagagagaactctctgctaagcccatccagagagttgagccttgcacaacttgtataaccaaatgcgagcctcatgggttggttgtccgatcaacagggttcaagatatcttctgcagttgcttgtgctagcggagtttgcgtcacaggatcacagagcccttctaccgagattacactcaagtatccaggaatatcccagtcctctgggggggacataggggttcacatggcacatgatgatcagtcagttagctccaaaatggtagctcactgccccccccaggacccgtgcctagtgcatggctgcatagtgtgtgctcatggcttgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcaggtgggtgtataagaagatggttgccagagtggcagacaatatcaatcaagtgaacagggaaataggatggatggaaggaggccagttggctctagggaaccctgcccctattcctcgtcatgccccaattccacgttatagcacatacctaatgctactattgattgtctcatatgcatcagcatgttcagaactgattcaggcaagctccagaatcaccacctgctccacagaaggtgtcaacaccaagtgtaggctgtctggcacagcattaatcagggcagggtcagttggggcagaggcttgtttgatgttaaagggggtcaaagaagaccaaaccaagttcttgaagataaaaactgtctcaagtgagctatcgtgcagggaaggccagagctattggactgggtcctttagccccaaatgcctgagctcaaggaggtgccatcttgtcggggaatgtcatgtgaataggtgtctgtcttggagggacaatgaaacttctgcagaattttcatttgttggggaaagcacgaccatgcgagagaataagtgttttgagcagtgtggaggatggggatgtgggtgtttcaatgtgaatccatcttgcttatttgtgcacacgtatctgcagtcggttagaaaagaggcccttagagttttcaactgtattgattgggtgcataaactcactctagagatcacagactttgatggctctgtttcaacattagacttgggagcatcatctagccgtttcacaaactggggttcggttagcctctcactggatgcagagggcatttcaggctcaaatagcttttctttcattgagagcccaggcaaagggtatgcaattgttgatgagccattctcagaaattcctcggcaagggttcttgggagagatcaggtgcaattcagaatcttcagtcctgagtgctcatgaatcatgccttagggcaccaaaccttatctcatacaagcctatgatagatcagttggagtgcacaacaaatctgattgatccctttgttgtctttgagaggggttctctgccacagacaaggaatgaaaaaacctttgcagcttcaaaaggaaataggggtgttcaagctttctccaagggctctgtacaagctgatcttactctgatgtttgacaattttgaggtggactttgtgggagcagccgtgtcttgtgatgccgccttcttaaatttaacaggttgctattcctgcaatgcaggagccagagtctgcttgtctatcacatccacaggaactggaactctctctgcccacaataaggatgggtctctgcacatagttcttccatcagagaatggaacaaaagatcagtgtcagatactacacttcactgtacctgaggtggaggaggagtttatgtactcttgtgatggagatgagcggcctctattggtgaaggggaccctgatagctattgatccatttgatgataggcgagaagcaggaggggaatcaacagttgtgaatccaaaatctggttcttggaatttctttgactggttttctggacttatgagttggtttggagggcctcttaagaccatactcctaatttgcctgtatgtggcattatcaattgggctctttttcctccttatatatcttggaagaacaggtctctctaaaatgtggcttgctgccactaagaaagcctcatag

SEQ ID NO: 4482 - RNA, 3480 nt, synthetic construct
  misc_feature 1..3480: note = derived and/or modified CDS sequence (wt) from RVFV(KEN/Kil-006/07)__HM586966.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtgggggtagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctgatggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgccactaagaaggcctcatag

SEQ ID NO: 4483 - RNA, 3480 nt, synthetic construct
  misc_feature 1..3480: note = derived and/or modified CDS sequence (wt) from RVFV(MgH824)__DQ380210.1__NSm-Gn-Gc
  source 1..3480: mol_type = other RNA
atgattgaaggagcttgggattcactcagagaggaggagatgccggaggagctctcctgttctatatcaggcataagggaggttaagacctcaagccaggagttatacagggcattaaaagccatcattgctgccgatggcttgaacaacatcacctgccatggtaaggatcctgaggacaagatttccctcataaagggtcctcctcacaaaaagcgggtggggatagttcggtgtgagaggcgaagagatgctaagcaaatagggagagaaaccatggcagggattgcaatgacagtccttccagccttagcagtttttgctttggcacctgttgtttttgctgaagacccccatctcagaaacagaccagggaaggggtacaactacattgacgggatgactcaggaggatgccacatgcaaacctgtgacatatgctggggcatgtagcagttttgatgtcttgcttgaaaaggggaaatttccccttttccagtcgtatgctcatcatagaactctactagaggcagttcacgacaccatcattgcaaaggctgacccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcgtaagggacagtacaaaggaacaatggactctggtcagactaagagggagctcaaaagctttgatatctctcagtgccccaagattggaggacatggtagtaagaagtgcactggggacgcagcattttgctctgcttatgagtgcactactcagtacgccaatgcctattgttcacatgctaatgggtcaggggttgtgcagatacaagtgtcaggggtctggaagaagcctttatgtgtaggatatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaatattaatcaagtgaacagggaaataggatggatggaaggaggtcagttggttctagggaaccctgcccctattcctcgtcatgccccaatcccacgttatagcacatacctgatgttactattgattgtctcatatgcatcagcatgttcagaactgattcaggcaagctccagaatcaccacttgctctacagagggtgttgacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacaaccatgcgagagaataagtgttttgagcagtgtggaggatgggggtgtgggtgtttcaatgtgaacccatcttgcttatttgtgcacacgtatctgcagtcagttagaaaagaggcccttagagtttttaactgtatcgactgggtacataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattcccagagattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgacccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacatttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaaggacaggcctctctaaaatgtggcttgctgccactaagaaggcctcatag

SEQ ID NO: 4484 - RNA, 3480 nt, synthetic construct
  misc_feature 1..3480: note = derived and/or modified CDS sequence (wt) from RVFV(SA01-1322)__KX096942.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgggagacgaagagatactaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcctcttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtaggagttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggccagaccaagagggagctcaaaagctttgatatctctcagtgccccaagattggagggcatggtagtaagaagtgcactggggacgcagcattttgctctgcttatgaatgcactgctcagtatgccaatgccttttgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgaacctcatggattggttgtccgatcaacagggttcaagatatcatctgcagttgcttgtgctagcggagtttgcgtcacagggtcgcagagtccttctactgagattacactcaagtatccagggatatcccagtcctctgggggggacataggggttcacatggcacatgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccattaatgtggattacagccttcatcagatgggtgtataagaagatggttgctagagtggcggacaatattaatcaagtgaacagggaaataggatggatggaaggaggtcagttggttctaggggaccctgcccctattcctcgtcatgccccaatcccacgttatagcacatacctaatgctgctattgattatctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggagtcaaggaagatcaaaccaagttcttaaagataaaaactgtctctagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggtaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgttattcctgcaatgcaggggccagagtctgcctgtctatcacatccacaggaactggaactctctctgcccacaataaggacgggtctctgcatatagttctcccatcagagaatgggacaaaagatcagtgtcagatactacatttcactgtgcctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggacttatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4485 - RNA, 3480 nt, synthetic construct
  misc_feature 1..3480: note = derived and/or modified CDS sequence (wt) from RVFV(Kenya 56 (IB8))__DQ380190.1__NSm-Gn-Gc
  source 1..3480: mol_type = other RNA
atgattgaaggagcttgggattcactcagagaggaggagatgccagaagagctctcctgttccatatcaggcataagggaggttaaaacctcaagccaggaattatatagggcattaaaagccatcattgctgctgatggcttgaacaacatcacctgccatggtaaggatcctgaggataagatttctctcataaagggtcctcctcacaaaaagcaggtggggatagttcggtgtgagagacgaagagacgctaagcaaataggaagagaaaccatggcagggattgcaatgacagtccttccagccttagcagtttttgctttggcacctgttgtttttgctgaagaccctcatctcagaaacagaccagggaaggggcacaactacattgacgggatgactcagggggatgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccttgcatgaaggagaaactcgtgatgaagacacactgtccaaaagactaccagtcagctcattacctcaacaatgacgggaaaatggcttcagtcaagtgccctcctaaatatgagctcactgaggactgcaatttttgcaggcagatgacaggtgccagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctaaaaagctttgatatctctcagtgccccaagattggaggacatggtagcaagaagtgcactggggacgcagctttttgctctgcttatgagtgcactgctcaatacgccaatgcttattgttcacatgctaatgggtcaggaattgtacagatacaagtatccggggtctggaagaggcctttgtgtgtagggtatgagagggtggttgtgaagagagaactctctgctaagcccatccagagagttgagccttgcacaacttgtataaccaaatgtgagcctcatggattggttgtccgatcaacaggtttcaagatatcatctgcagttgcttgtgctagcggagtttgcgttacaggatcgcagagcccttctaccgagattacactcaagtatccagggatgtcccagtcctctgggggggacataggggttcatatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctgaatccactaatgtggattactgctttcatcagatgggtgtataagaagatggttgccagagtggcagacaatatcaatcaggtgaacagggaaataggatggatggaaggaggccagccggctctagggaaccctgcccctattcctcgtcatgctccaattccacgttatagcacatacctaatgctactattgattgtctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagagagggccagagctattggactgggtcctttagccctaaatgtctgagctcaaggaggtgccatcttgtcggggaatgtcatgtgaataggtgtctgtcttggagagacaatgaaacttcagcagaattttcatttgttggggaaagcacgaccatgcgggagaataagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgatggctctgtttcaacaatagacctgggagcatcatctagccgtttcacaaactggggttcagttagcctctcactggacgcagagggcatttcaggctcaaacagcttttctttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaaccttatttcatacaagcccatgatagatcagttggagtgcacaacaaatctgattgatccctttgttgcctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatgggtctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttcctccttatatatcttggaagaacaggcctctctaaaatgtggcttgctgccaccaagaaagcctcatag

SEQ ID NO: 4486 - RNA, 3480 nt, synthetic construct
  misc_feature 1..3480: note = derived and/or modified CDS sequence (wt) from RVFV(KEN/Mal-032/07)__HM586967.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggagacttcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctgatggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4487 - RNA, 3480 nt, synthetic construct
  misc_feature 1..3480: note = derived and/or modified CDS sequence (wt) from RVFV(KEN/Gar-008/06)__HM586965.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaagggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataatttgaaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtaaaagaggagttcatgtactcttgtgatggagatgagcgggctctgttaatgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4488 - RNA, 3480 nt, synthetic construct
  misc_feature 1..3480: note = derived and/or modified CDS sequence (wt) from RVFV(Beijing-01)__KX611606.1__NSm-Gn-Gc
  source 1..3480: mol_type = other RNA
atgattgaaggagcttgggattcactcagagaggaggagatgccagaagagctctcctgttccatatctggcataagggaggtcaagacctcaagccaggaattatacagggcattaaaagccatcattgctgctgatggcttgaacaacatcacctgccatggtaaggatcctgaggacaaaatttctctcataaagggtcctcctcacaagaagcgggtggggatagttcggtgtgagagacgaagggacgctaagcaaatagggagagaaaccatggcagggattgcaatgacagttcttcccgccttagcagtttttgctttggcacctgttgtttttgctgaggaccctcatctcagaaacagaccagggaagggacataactacattgacggggtgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgatccacctagctgtgatctccagagtgctcatgggaatccctgcatgaaagagaaactcgtgatgaagacacactgtccaaatgactaccagtcagctcattacctcaacaatgacgggaaaatggcttcagtcaagtgccctcctaagtatgagcttactgaggactgcaacttttgtaggcagatgacaggtgctagcttgaagaaggggtcttatcctctccaggacttattttgtcagtcaagtgaggatgatggatcaaaactaaagacaaaaatgaaaggggtctgcgaagtgggggttcaagcactcaaaaagtgtgatggccgactcagcactgcacatgaggttgtgccctttgcagtgtttaagaattcaaagaaggtttatcttgacaagcttgaccttaagactgaagaaaatctgctaccagactcatttgtctgctttgagcataagggacagtataaaggaacaatggactctggtcagactaagagggagctcaaaagctttgatatctctcagtgccccaagattgggggacatggtagcaagaagtgcactggggacgcagcattttgctctgcttatgagtgtactgctcaatatgccaatgcctattgttcacatgctaatgggtctgggattgtacagatacaagtatccggggtctggaagaagcctttatgtgtggggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgccagcggagtttgcgtcacaggatcgcagagcccttctactgagatcactctcaagtatccagggatatcccagtcctctgggggggatataggggttcacatggcacatgatgatcagtcagttagctccaaaatagtctttgactgccctccccaggacccgtgcctagtgcatggctgcatagtgtgtgctcatggcttgataaattaccagtgtcacactgctcttagtgcttttgttgttgtgttcgtattcagctctgttgcaataatttgtctggccattctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgctcccattcctcgtcatgctccgattccacgttatagcacatacctaatgctactattgattatctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgtttgagggggtcaaggaagaccagaccaagttcttaaagataaaaactgtctcaagtgagctatcgtgcagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtggatgtttcaatgtgaacccatcttgcttatttgtgcacacgtatctgcaatcagttagaaaagaggctcttagagtttttaactgtattgattgggtgcataaactcactctagagatcacagactttgatggctctgtttcaacaatagacttgggagcatcatctagccgtttcacaaactggggctcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttctgtcctgagtgctcatgagtcatgccttagggcaccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaaaggctctgtacaggctgatctaactctgatgtttgacaattttgaggtggactttgtgggagcagccgtgtcttgtgatgccgccttcttaaatttgacaggttgctattcctgcaatgctggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagttcatgtactcttgtgatggagatgagcgacctttgttggtgaaggggaccctaatagctattgatccatttgatgataggcgagaagcagggggagaatcaacagttgtgaatccaaaatctggatcttggaacttctttgactggttttctggacttatgagttggtttggaggacctcttaagactatactcctaatttgcctgtatgtagcattatcaattgggctctttttccttcttatatatcttggaagaacaggtctctctaaaatgtggcttgctgccactaagaaagcctcatag

SEQ ID NO: 4489 - RNA, 3480 nt, synthetic construct
  misc_feature 1..3480: note = derived and/or modified CDS sequence (wt) from RVFV(KEN/Bar-035/07)__HM586969.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggagacttcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctgacggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcacggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4490 - RNA, 3480 nt, synthetic construct
  misc_feature 1..3480: note = derived and/or modified CDS sequence (wt) from RVFV(KEN/Bar-032/07)__HM586968.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggagacttcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgacccacctagctgtgaccttcagagtgctgatggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaaatgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgtgggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctcacacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgaggtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4491 - RNA, 3480 nt, synthetic construct
  misc_feature 1..3480: note = derived and/or modified CDS sequence (wt) from RVFV(TAN/Dod-002/07)__HM586971.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggtccaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtaggaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcaggcctggataatctctcagtggcacacggctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4492 - RNA, 3480 nt, synthetic construct
  misc_feature 1..3480: note = derived and/or modified CDS sequence (wt) from RVFV(Smithburn)__DQ380193.1__NSm-Gn-Gc
  source 1..3480: mol_type = other RNA
atgattgaaggagcttgggattcactcagagaggaggagatgccagaggagctctcctgttccatatcaggcataagggaggttaagacctcaagccaggaattatacagggcattaaaagccaccattgctgctgatggcttgaacaacatcacctgccatggtaaggatcctgaggacaagatttctctcataaagggtcctcctcacaaaaagcgggtgggggtagttcggtgtgagagacaaagagacgctaagcaaatagggagaggaaccatggcagggattgcaatgacagtctttccagccttagtagtttttgctttggcacctgttgtttttgctgaagaccctcatctcagaaacagaccagggaagggacacaactacattgacgggatgactcaggaggatgccacatgtaaacctgtgacatatgctggggcatgtagcagttttgatgtcttgctcgaaaagggaaaatttcccctcttccagtcgtatgctcatcatagaactctattagaggcagttcacgacatcatcattgcaaaggctgatccacctagctgtaaccttcagagtgctcatgggaatccctgcatgaaagagaaactcgtaatgaagacatactgtccaaatgactaccagtcagctcattacctcaacaatgacgggaaaatggcttcagtcaagtgccctcctaagcatgagctcactgaggactgcaacttttgtaggcagatgacaggtgctagcttgaaggaggggtcttatcctctccaagacttattttgtcagtcaagtgaggatgatggatcaaaattaaaaacaaaaatgaaaggggtctgcgaagtgggggttcaagtactcaaaaagtgtgatggccaactcagcactgcacatgaagttgtgccctttgcagtgtttaagaactcaaagaaggtttatcttgacaagcttgacctcaagactgaggaaaatctgctaccagactcatttgtctgcttcgagcataagggacagtacaaaggaacaatggactctggtcagattaagagggagctcaaaagctttgatatctctcagtgccccaagattggaggacatggtagcaagaagtgcactggggacgcagcattttgctctgcttatgagtgtactgctcaatacgccaatgcctattgttcacatgctaatgggtcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctactgagattacactcaagtatccagggatatcccagtcctctgggggagacataggggttcacatggcacatgatgatcagtcagttagctccaaaatagtggcccactgccccccccaggacccgtgcctagtgcatggctgcatagtgtgtgctcatggcttgataaattaccagtgtcacactgctttcagtgcctttgttgttgtgttcgtattcagctctgttgtgataatttgtttggccattctttataaggtgctcaagtgcctaaagattgccccaaggaaagttctgaatccactaatgtggatcactgccttcatcagatgggtgtataagaagatggttgccagagtggcagacaatattaatcaagtaaacagggaaataggatggatggaaggaggccagttggttctagggaaccctgcccctattcctcgtcatgctccaattccacgttatagcacatacctaatgctgctattgattgtctcatatgcatcagcatgttcagaactaattcaggcaagctccagaatcaccacttgctccacagaaggtgtcaacaccaagtgcaggctgtctggcacagcattaatcagggcagggtcagttggggcagaggcttgtttgatgttaaagggggtcaaggaagaccagaccaagttcttgaagataaaaactgtctcaagtgagctatcatgtagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgaacagtgtggaggatggggatgtgggtgtttcaatgtgaacccatcttgcttatttgtgcacacgtatctgcagtcagttagaaaagaagcccttagagtttttaactgtattgattgggtgcataaactgactctagagattacagactttgatggctctgtttcaacagtagacttgggagcatcatctagccgtttcacaaactggggttcagtcagcctctcactggacgcagagggcatttcaggctcaaatagcttctctttcattgagagcccaggcaaagggtatgcaattgttgatgagccattctcagaaattcctcggcaagggttcttgggagagatcaggtgcaattcagaatcttcagtcctgagtgctcatgaatcatgccttagggcaccaaaccttatctcatacaaacccatgatagatcagttggagtgcacaacaaatctgattgatccctttgttgtctttgagaggggttctctgcctcagacaaggaatgacaaaacctttgcagcttcaaaaggaaataggggtgttcaagctttctctaagggctctgtacaagctgatctaactctgatgtttgacaattttgaggtggactttgtgggagcagccgtgtcttgtgatgccgccttcttaaacttgacaggttgctattcctgcaatgcaggggccagagtctgcctgtctatcacatccacaggaactggaactctttctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatagctattgatccatttgatgataggcgagaagcagggggggaatcaacagttgtgaatccaaaatctggatcttggaatttctttgactggttttctggacttatgagttggtttggagggcctcttaagactatactcctaatttgcctgtatgtagcattatcaattgggctttttttctttcttatatatcttggaagaacaggtctctctaaaatgtggcttgctgccactaagaaagcttcatag

SEQ ID NO: 4493 - RNA, 3480 nt, synthetic construct
  misc_feature 1..3480: note = derived and/or modified CDS sequence (wt) from RVFV(KEN/Gar-004/06)__HM586964.1__NSm-Gn-Gc
  source 1..3480: mol_type = other RNA
atgattgaaggagcttgggattcactcagagaggaggagatgccagaggagctctcctgctctgtatcaggcataagggaggttaagacctcaagccaggagttatacagagcattaaaagccatcattgctgctgatggcttgaacaacatcacctgccatggtaagaatcctgaggacaagatttctctcataaagggtcctcctcacaaaaagcgggtggggatagtccggtgtgagagacgaagagatgctaagcaaatagggagagaaaccatggcagggattgcgatgacagtccttccagccttagcagtttttgctttggcacctgttgtttttgctgaagacccccatctcagaaacagaccagggaaggggcacaactacattgacggaatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcacagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtaggaagaagagaactggggacgcagcattttgctctgcttatgaatgcactgctcagtatgccaatgcctattgttcacgtgccaacgggtcagggattgtgcagattcaagtatcaagggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaataaccagtcacactctgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagattacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgaggtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4494 - RNA, 3204 nt, synthetic construct
  misc_feature 1..3204: note = derived and/or modified CDS sequence (wt) from RVFV(ZH-548)__DQ380206.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4495 - RNA, 3204 nt, synthetic construct
  misc_feature 1..3204: note = derived and/or modified CDS sequence (wt) from RVFV(2007000094)__EU574055.1__Gn-Gc
  source 1..3204: mol_type = other RNA
atggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctgctagaggcagttcatgacaccatcattgcaaaggctgatccacctagctgtgacctccagagtgctcatgggaatccctgtatgaaagagaaacttgtgatgaagacacattgtcctaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagcatgttcagaactgattcaggcaagctccagaatcaccacttgctccacagagggtgtcaacaccaagtgtagactgtctggcacagcattgatcagggcagggtcagttggggcggaagcttgtttgatgttgaagggggtcaaggaagatcaaaccaagttcttaaagataaaaactgtctcaagtgagctatcgtgcagggagggccagagctattggactgggtcctttagccccaagtgcctgagctcaagaagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctcatag

SEQ ID NO: 4496 - RNA, 3204 nt, synthetic construct
  misc_feature 1..3204: note = derived and/or modified CDS sequence (wt) from RVFV(ZH-548M12)__M25276.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcatcacctcaacaatgacgggaaaatggcttcagtcaagtgccctcctaagtatgagctcactgaagactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagttaaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaggaacaggcctctctaaaatgtggcttgctgccactaagaaggcctcatag

SEQ ID NO: 4497 - RNA, 3204 nt, synthetic construct
  misc_feature 1..3204: note = derived and/or modified CDS sequence (wt) from RVFV(Sudan 86-2010)__JQ820489.1__Gn-Gc
  source 1..3204: mol_type = other RNA
atggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaaccctactagaggcagttcacgacaccatcattgcaaaggctgatccacctagctgtgacctccagagtgctcatgggaatccctgtatgaaagagaaacttgtgatgaagacacattgtccaaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcaaagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtactcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccctgcccctattcctcgtcatgccccaatcccacgttatagcacatacctaatgctactactgattgtctcatatgcatcagcatgttcagaactgattcaggcaagttccagaatcaccacttgctccacagagggtgtcaacaccaagtgtagactgtctggcacagcattgatcagggcagggtcagttggggcggaggcttgtttgatgttgaagggggtcaaggaagatcaaaccaagttcttaaagataaaaactgtctcaagtgagctatcgtgcagggagggccagagctattggactgggtccttcagccccaagtgcctgagctcaaggagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttatctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatctgacaggttgctattcttgcaatgcaggggccagagtttgcctgtctatcacatccacaggaactgggactctctctgcccacaataaggacgggtctctgcatatagttctcccatcagagaatgggacaaaagatcagtgtcagatactacatttcaccgtacctgaagtagaagaggagtttatgtactcttgtgatggagatgagcggcctctgttagtgaaagggaccctgatagctattgacccatttgatgataggcgggaggctgggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctcatag

SEQ ID NO: 4498 - RNA, 3204 nt, synthetic construct
  misc_feature 1..3204: note = derived and/or modified CDS sequence (wt) from RVFV(ZS-6365)__DQ380205.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaagaagatcaaaccaagttcttaaagataaaaactgtctcaagtgagctatcatgcagggagggccagagttattggactgggtcctttagtcctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgtccaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctcttttttctccttatatatcttggaagaacaggcctctctaaaatgtggcttgctgccactaagaaggcctcatag

SEQ ID NO: 4499 - RNA, 3204 nt, synthetic construct
  misc_feature 1..3204: note = derived and/or modified CDS sequence (wt) from RVFV(1853/78)__DQ380220.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgacccaggaggatgccacatgcaaacctgtgacatatgctggggcatgtagcagttttgatgtcttgcttgagaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaagactgcaacttttgtagacagatgacaggtgctagcctaaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttacctcgataagcttgacctcaagactgaggagaatctgctaccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcaggggttgtgcagatacaagtgtcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagtccttctaccgagattacactcaagtatccagggatatcccagtcctctgggggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtgttcagttctattgcaataatttgtttagctattctttatagggtgctcaaatgcttaaagattgccccaaggaaagttctgaatccactaatgtggattacagccttcatcagatgggtgtataagaagatggttgccagagtggcagacaatattaatcaagtgaacagggagataggatggatggaaggaggtcagttggttctaggaaaccctgcccctattcctcgtcatgccccaattccacgttatagcacatacctaatgctactactaattgtctcatatgcatcagcatgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcctaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagtacgaccatgcgagagaataagtgttttgagcagtgtggaggatggggatgtggatgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtatttgagaggggttctctgccacagacaaggaatgacaaaacctttgcagcttcaaaaggaaatagaggtgttcaagctttctctaagggctctgtgcaagctgatctaactctgatgtttgacaattttgaggtggactttgtgggagcagctgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgccagatactacacttcactgtacctgaagtagaggaggagtttatgtactcttgtgatggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctcctcatatatcttggaagaacaggcctctctaaaatgtggcttgctgctactaagaaggcctcatag

SEQ ID NO: 4500 - RNA, 3204 nt, synthetic construct
  misc_feature 1..3204: note = derived and/or modified CDS sequence (wt) from RVFV(T1)__DQ380201.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatctcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgataaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4501 - RNA, 3204 nt, synthetic construct
  misc_feature 1..3204: note = derived and/or modified CDS sequence (wt) from RVFV(Kenya 83 (21445))__DQ380198.1__Gn-Gc
  source 1..3204: mol_type = other RNA
atggcagggattgcaatgacagtccttccagccttagcagtttttgctttggcacctgttgtttttgctgaagacccccacctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaactcgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaaaaaggggtcttaccctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgtttcgagcataagggacagtataaaggaacaatggactctggtcagaccaagagggagctcaaaagctttgatatctctcagtgccccaagattggagggcatggtagtaagaagtgcactggggacgcagcattctgctctgcttatgagtgcactgctcagtacgccaatgcctattgttcacatgctaatgggtcagggattgtgcagattcaagtatcaggggtctggaagaagcctttatgtgtagggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgctagcggggtttgcgtcacaggatcgcagagtccttctactgagattacactcaagtatccagggatatctcagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagctttcatcagatgggtgtataagaagatggttgctagagtggcagacaacattaatcaagtgaacagggaaataggatggatggaaggaggtcagttggctctagggaaccctgcccctattcctcgtcatgccccaatcccacgttatagcacatacctaatgctactattgattgtctcatatgcatcagcatgttcagaactgatccaggcaagctccagaatcaccacttgctccacagagggtgtcaacaccaagtgtagactgtctggcacagcattgatcagggcagggtcagttggggcagaggcttgtttgatgttgaagggggtcaaggaggatcaaaccaaattcttaaagataaaaacagtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggttcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgacccctttgttgtctttgagaggggttctctgccacagacaaggaatgacaaaacctttgcagcttcaaaaggaaatagaggtgttcaggctttctctaagggctctgtacaagctgatctgactctgatgtttgacaattttgaggtggactttgtgggagcagccgtgtcttgtgatgccgccttcttgaatttgacaggttgctattcttgtaatgcaggggccagggtctgcctgtctatcacatccacaggaactggaactctctctgcccacaataaggatgggtctctgcatatagttctcccatcagagaatgggacaaaagatcagtgtcagatactacacttcactgtacctgaagtagaggaggagtttatgtactcttgtgatggagatgagcggcctctgttagtgaaagggaccctgatagctattgacccatttgatgataggcgggaagcaggaggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgccgctactaagaaggcctcatag

SEQ ID NO: 4502 - RNA, 3204 nt, synthetic construct
  misc_feature 1..3204: note = derived and/or modified CDS sequence (wt) from RVFV(Sudan 85-2010)__JQ820488.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgcccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcacagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcgtatttgtattcagttctattgcaataatttgcttagccattctttatagggtgctcaagtgcttaaagattgccccaaggaaagttctgaatccactaatgtggattacagccttcatcagatgggtgtataagaagatggttgctagagtggcagacaatattaatcaagtgaacagagaaataggatggatggaaggaggtcagttggttctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaagaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaacaagtgttttgagcagtgtggaggatgggggtgtggatgcttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggctcagttagcctctcactggacgcagagggcatttcaggctcaaatagcttttcttttattgagagcccaggcaaagggtatgcaattgttgatgagccattctcagagatccctcggcaagggttcttgggggagattaggtgtaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaacaaggacgggtctctgcatatagttctcccatcagagaatgggacaaaagatcagtgtcagatactacatttcactgtacctgaagtagaagaggagttcatgtactcttgtgatggagatgagcggcctctgttagtgaaagggaccctgatagctattgacccatttgatgataggcgggaagcagggggggaatcaacagttgtgaatccaaaatctggatcttggaacttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4503 - RNA, 3204 nt, synthetic construct
  misc_feature 1..3204: note = derived and/or modified CDS sequence (wt) from RVFV(2007004194)__EU574031.1__Gn-Gc
  source 1..3204: mol_type = other RNA
atggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctgctagaggcagttcatgacaccatcattgcaaaggctgatccacctagctgtgacctccagagtgctcatgggaatccctgtatgaaagagaaacttgtgatgaagacacattgtcctaacgactaccagtcagctcattacctcagcaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagcatgttcagaactgattcaggcaagctccagaatcaccacttgctccacagagggtgtcaacaccaagtgtagactgtctggcacagcattgatcagggcagggtcagttggggcggaagcttgtttgatgttgaagggggtcaaggaagatcaaaccaagttcttaaagataaaaactgtctcaagtgagctatcgtgcagggagggccagagctattggactgggtcctttagccccaagtgcctgagctcaagaagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctcatag

SEQ ID NO: 4504 - RNA, 3204 nt, synthetic construct
  misc_feature 1..3204: note = derived and/or modified CDS sequence (wt) from RVFV(2250/74)__DQ380209.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaagtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtaggatatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaatattaatcaagtgaacagggaaataggatggatggaaggaggtcagttggttctagggaaccctgcccctattcctcgtcatgccccaatcccacgttatagcacatacctgatgttactattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcagtgtggaggatgggggtgtgggtgttttaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagagattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccaaggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4505 - RNA, 3204 nt, synthetic construct
  misc_feature 1..3204: note = derived and/or modified CDS sequence (wt) from RVFV(Sudan 28-2010)__JQ820491.1__Gn-Gc
  source 1..3204: mol_type = other RNA
atggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgacctccagagtgctcatgggaatccctgtatgaaagagaaacttgtgatgaagacacattgtccaaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaaaactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggtagtgaagagagaactctcagccaaacccatccagagagttgagccttgcacaacttgcataaccaaatgtgagcctcatggattggttgtccgatcaacagggttcaagatatcgtctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagcatgttcagaactgattcaggcaagctccagaatcaccacttgctctacagagggtgtcaacaccaagtgtagactgtctggcacagcattgatcagggcagggtcagttggggcggaggcttgtttgatgttgaagggggtcaaggaagatcaaaccaagttcttaaagataaaaactgtttcaagtgagctatcgtgcagggagggccagagctattggactgggtcctttagccccaagtgcctgagctcaagaagatgccatcttgtcggagaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgtattatcaattgggctcttcttcctccttatatatcttggaagaacaggcctctctaaaatgtggcttgctgctactaagaaggcctcatag

SEQ ID NO: 4506 - RNA, 3204 nt, synthetic construct
  misc_feature 1..3204: note = derived and/or modified CDS sequence (wt) from RVFV(2007000324)__JF326195.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaagggaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4507 - RNA, 3204 nt, synthetic construct
  misc_feature 1..3204: note = derived and/or modified CDS sequence (wt) from RVFV(ZM-657)__DQ380204.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaaagcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagtcctaaatgtttgagctcaaggagatgccaccttgtcggggaatgccatgtgaataggtgtctgtcttggagggacaatgaaacttcagcagagttttcatttgttggggaaagcacaaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctcttttttctccttatatatcttggaagaacaggcctctctaaaatgtggcttgctgccactaagaaggcctcatag

SEQ ID NO: 4508 - RNA, 3204 nt, synthetic construct
  misc_feature 1..3204: note = derived and/or modified CDS sequence (wt) from RVFV(T-46 (228113))__DQ380199.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaaaggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatctcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgataaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4509 - RNA, 3204 nt, synthetic construct
  misc_feature 1..3204: note = derived and/or modified CDS sequence (wt) from RVFV(MP12)__Z30318.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcatcacctcaacaatgacgggaaaatggcttcagtcaagtgccctcctaagtatgagctcactgaagactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcacacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagttaaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaggaacaggcctctctaaaatgtggcttgctgccactaagaaggcctcatag

SEQ ID NO: 4510 - RNA, 3204 nt, synthetic construct
  misc_feature 1..3204: note = derived and/or modified CDS sequence (wt) from RVFV(200803166)__JF311381.1__Gn-Gc
  source 1..3204: mol_type = other RNA
atggcagggattgcgatgacagtccttccagccctagcggtttttgctttagcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttaaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggatccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagggaaataggatggatggaaggaggtcagttggttctagggaaccctgcccctattcctcgtcatgccccaatcccacgttatagcacatacctaatgctactattgattgtctcatatgcaacagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggttaaggaagatcaaaccaagttcttgaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagtctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatgtagttctcccatcagagaatgggacaaaagatcagtgtcagatactgcatttcactgtacctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4511 - RNA, 3204 nt, synthetic construct
  misc_feature 1..3204: note = derived and/or modified CDS sequence (wt) from RVFV(200803162)__JF311377.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaaatatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtatagccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctaaggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4512 - RNA, 3204 nt, synthetic construct
  misc_feature 1..3204: note = derived and/or modified CDS sequence (wt) from RVFV(Hv-B375)__DQ380218.1__Gn-Gc
  source 1..3204: mol_type = other RNA
atggcagggattgcaatgacagtccttccagccttggcagtttttgctttggcacctgttgtttttgctgaggacccccatctcagaaacagaccagggaaggggcacaactacattgacgggatgacccaggaggatgccacatgcaaacctgtgacatatgctggggcatgtagcagttttgatgtcttgcttgagaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagaatgagctcactgaggactgcaacttttgtaggcagatgacaggtgctagcctaaagaaggggtcttatcctctccaagacttattttgccagtcaagtgaggatgatggatcaaaattaaaaacaaaaatgaaaggggtctgcgaagtgggggtccaagcactcaaaaagtgtgatggccaactcagcaccgcacatgaggttgtgccctttgcagtgttcaagaactcaaagaaggtttacctcgataagcttgacctcaagactgaggagaatctgctgccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtgtcaggggtctggaagaagcctttatgtgtagggtatgagagagtggttgtgaagagagaactctctgccaagcccatccagagagttgagccttgcacaacttgtataaccaaatgtgagcctcatggtttggttgtccgatcaacagggttcaagatatcatctgcagttgcttgtgctagcggagtttgcgtcacaggatcacagagcccttctaccgagattacactcaagtatccagggatatcccagtcctctgggggggacataggggttcacatggcacacgatgatcagtcagttagctccaaaatagtagctcactgccctccccaggacccatgcttagtgcacggctgcatagtgtgtgctcatggcctgataaattaccagtgtcacactgccctcagtgcctttgttgttgtgtttgtattcagttctattgcaataatttgtttagccattctttatagggtgctcaagtgcttaaagattgccccaaggaaagttctgaatccactaatgtggatcacagccttcatcagatgggtgtataagaagatggttgccagagtggcagacaatattaatcaagtgaacagggagataggatggatggaaggaggtcagttggttctagggaaccctgctcctattcctcgtcatgccccaattccacgttatagcacatacctaatgctactgctaattgtctcatatgcatcagcatgttcagaactaattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagtacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaactcagagtcctcagtcctgagtgctcatgaatcatgccttagggcaccaaaccttatctcatacaagcccatgatagatcaattggagtgcacaacaaatctgattgatccctttgttgtatttgagaggggttctctgccacagacaaggaatgacaaaacctttgcagcttcaaaaggaaatagaggtgttcaagctttctctaagggctctgtgcaagctgatctaactctgatgtttgacaattttgaggtggactttgtgggagcagctgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcaatgccagatactacacttcactgtacctgaagtagaggaggagtttatgtactcttgtgatggagatgagcggcctctattagtgaaagggaccctgatagctattgatccatttgatgataggcgggaagcagggggagaatcaacagttgtgaatccaaaatctggatcttggaatttctttgactggttttctggactcatgagttggtttggagggcctctcaaaactatactcctcatttgcctgtatgttgcattatcaattgggctctttttcctcctcatatatcttggaagaacagggctctctaaaatgtggcttgctgctactaagaaggcctcatag

SEQ ID NO: 4513 - RNA, 3204 nt, synthetic construct
  misc_feature 1..3204: note = derived and/or modified CDS sequence (wt) from RVFV(1260/78)__DQ380214.1__Gn-Gc
  source 1..3204: mol_type = other RNA
atggcagggattgcaatgacagtccttccagccttagcagtttttgctctagcacctgttgtttttgctgaagacccccatctcagaaacagaccggggaaggggcacaactacattgacgggatgactcaggaggatgccacatgcaaacctgtgacatatgctggggcatgtagcagttttgatgtcttgcttgaaaaagggaaatttcccctcttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcacagaggactgcaacttttgtaggcagatgacaggtgctagcctgaagaaggggtcttatcctctccaagacttattttgtcagtcaagtgaggacgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcacaagggacagtataagggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcttattgttcacatgctaatgggtcagggattgtgcaaatacaagtatcaggggtctggaagaagcctttatgtgtagggtatgagagagtggttgtaaagagagaactctctgccaagcccatccagagagttgagccttgcacaacttgtataaccaaatgtgagcctcatggattggttgtccgatcaacagggttcaaaatatcatctgcagttgcttgtgctagcggagtttgcgtcacaggatcgcagagtccttccaccgagattacactcaagtatccagggatatcccagtcctctgggggggacataggggttcacatggcacatgatgaccagtcagttagctccaaaatagtagctcactgccctccccaggacccgtgcttagtgcatggctgcatagtgtgtgctcatggcctgataaattaccagtgtcacactgctctcagtgcctttgttgttgtgtttgtgttcagttctattgcaataatttgtttagctattcttcatagggtgctcaagtgcttaaagattgccccaaggaaggttctgaatccactaatgtggattacagccttcatcagatgggtgtataagaagatggttgccagagtggcagacaatattaatcaagtgaacagggaaataggatggatggaaggaggtcagttggttctagggaaccctgcccctattcctcgccatgccccaattccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtctgatgttgaagggggtcaaggacgatcaaaccaagttcttaaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagggacaatgaaacttcagcagagttttcatttgttggggaaagcacgaccatgcgggagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcacactagagatcacagactttgatggctctgtttcaacaatagacctgggggcatcatctagccgtttcacaaactggggttcagttagcctctcactggacgcagagggcatttcaggctcaaatagcttttctttcattgaaagcccaggcaaaggatatgcaattgttgatgagccattctcagaaattcctcgacaagggttcctgggggagatcaggtgcaattcagagtcctcagtcctgagtgctcatgaatcatgccttagggcaccaaaccttatctcatacaagcccatgatagaccaattggagtgcacaacgaatctgattgatccctttgttgtctttgagaggggttctctgccacagacaaggaatgacaaaacctttgcagcttcaaaaggaaatagaggtgtccaagctttctctaagggctctgtacaagctgatctaactctgatgtttgacaattttgaggtggactttgtgggagcagccgtatcttgtgatgccgccttcctaaatttgacaggttgctattcttgcaatgcaggggccagggtctgcctgtctatcacatccacaggaactggaaccctctctgcccacaataaggatgggtctctgcatatagttcttccatcagagaatggaacaaaagatcaatgccagatactacacttcactgtacctgaggtagaggaggagtttatgtactcttgtgacggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctcctcatatatcttggaagaacaggcctctctaaaatgtggcttgccgctactaagaaggcctcatag

SEQ ID NO: 4514 - RNA, 3204 nt, synthetic construct
  misc_feature 1..3204: note = derived and/or modified CDS sequence (wt) from RVFV(ZH-501-777)__DQ380202.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggaccctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtaaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatctcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgataaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 4515 - RNA, 3204 nt, synthetic construct
  misc_feature 1..3204: note = derived and/or modified CDS sequence (wt) from RVFV(OS-3)__DQ380184.1__Gn-Gc
  source 1..3204: mol_type = other RNA
atggcagggattgcaatgacagtccttccagccttagcagtttttgctttggcacctgttgtatttgctgaagacccccatctcagaaatagaccagggaaggggcacaactacattgacgggatgactcaggaggatgccacttgtaaacctgtgacatatgctggggcatgtagcagttttgatgtcttgctcgaaaagggaaaattccccctcttccagtcgtatgctcatcatagaactctactagaggcagttcatgacaccatcattgcaaaggctgatccacctagttgtgatcttcagagtgctcatgggaatccttgcatgaaagagaaactcgtgatgaagacacactgtccaaatgactaccagtcagcccactacctcaacaatgatgggaaaatggcctcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaggcactcaagaagtgtgatggccagctcagcactgcacatgaggttgtgccctttgcagtgtttaagaactcaaagaaggtttatcttgacaagcttgacctcaaaactgaagaaaatctgctaccagactcatttgtctgcttcgagcataagggacagtataaaggaacaatggactctggtcaaactaagagggagctcaaaagctttgatatctctcagtgccccaagattggaggacatggtagcaagaagtgcactggggacgcagcattttgctctgcttatgagtgcactgctcaatacgccaatgcctattgttcacatgctaatgggtcaggagttgtgcagatacaagtatccggggtctggaagaaacctttatgtgtagggtatgagagagtggttgtgaagagagaactctctgccaaacccatccagagagttgagccttgcacaacctgtataaccaaatgtgagcctcatggattggttgtccgatcaacagggttcaagatatcatctgcagttgcatgtgctagcggagtttgtgtcacaggatcgcagagtccttctaccgagatcacactcaagtatccagggatatcccagtcctctgggggggacataggggttcacatggcacacgatgatcagtcagttagctccaaaatagtagctcactgccccccccaggacccgtgcctagtgcatggctgcatagtgtgtgctcatggcctaataaattaccagtgtcacactgctctcagtgcctttgttgttgtgttcgtattcagctctgttgcaataatttgtttggccattctttataaggtgctcaagtgcctaaagattgccccaaggaaagttctaaatccactaatgtggattactgccttcatcagatgggtgtataagaagatggttgccagggtggcagacaatattaatcaagtgaacagagaaataggatggatggagggaggtcagttggctctagggaaccctgcccctattcctcgtcatgccccaattccacgttatagcacatacctgatgctactattgattgtctcatatgcatcagcatgttcagaactgattcaggcaagctctagaataaccacttgctccacagaaggtgtcaacaccaagtgtaggctgtctggcacagcattaatcagggcagggtcagttggggcagaggcttgcttgatgttaaagggagtcaaggaggaccaaacaaagttcttgaagataaaaactgtctcaagtgagctatcgtgcagggaaggccagagctattggactggatcctttagtcccaaatgtctgagctcaaggagatgccatcttgtcggggaatgtcatgtgaataggtgtctgtcttggagggacaatgaaacttcagcagagttttcatttgttggggaaagcacgactatgcgagagaataaatgttttgagcagtgtgggggatggggatgtgggtgcttcaatgtgaacccatcttgcttgtttgtgcacacgtatctgcagtcagttagaaaagaggcccttagagtttttaactgtatcgattgggtgcataaactcactctagagatcacagactttgatggttctgtttcaacaatagacttgggagcatcatctagccgtttcacaaactggggctcagttagcctctcactggatgcagagggcatttcaggctcaaatagcttttctttcattgagagcccaggcaaagggtatgcaattgttgatgagccattctcagaaatccctcggcaagggttcttgggggagatcaggtgcaattcagaatcttcagtcctgagtgctcatgaatcatgccttcgggcaccaaacctcatctcatacaagcccatgatagaccagttggagtgcacaacaaatctgattgatccctttgttgtctttgagaggggttctctgcctcagacaaggaatgataaaacttttgcagcttcaaaaggaaataggggtgttcaagctttctctaagggctctgtacaagctgatttaactctgatgtttgacaattttgaggtggactttgtgggagcagccgtgtcttgtgatgccgctttcttaaatctgacaggttgttattcttgtaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatcgccattgatccatttgatgacaggcgggaagcagggggagaatcaacagttgtgaatccaaaatctggatcttggaatttctttgactggttttctggactcatgagttggtttggagggcctcttaagactatactcctcatttgcctgtatgttgcattatcaattgggctctttttccttctcatatatcttggaagaacaggtctctctaaaatgtggcttgctgctactaagaaggcctcataa

SEQ ID NO: 4516 - RNA, 3204 nt, synthetic construct
  misc_feature 1..3204: note = derived and/or modified CDS sequence (wt) from RVFV(SAUDI 200010901)__KU978778.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcctcttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggagttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggccagaccaagagggagctcaaaagctttgatatctctcagtgccccaagattggagggcatggtagtaagaagtgcactggggacgcagcattttgctctgcttatgaatgcactgctcagtatgccaatgccttttgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgaacctcatggattggttgtccgatcaacagggttcaagatatcatctgcagttgcttgtgctagcggagtttgcgtcacagggtcgcagagtccttctactgagattacactcaagtatccagggatatcccagtcctctgggggggacataggggttcacatggcacatgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccattaatgtggattacagccttcatcagatgggtgtataagaagatggttgctagagtggcggacaatattaatcaagtgaacagggaaataggatggatggaaggaggtcagttggttctagggaaccctgcccctattcctcgtcatgccccaatcccacgttatagcacatacctaatgctgctattgattatctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggagtcaaggaagatcaaaccaagttcttaaagataaaaactgtctctagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgttattcctgcaatgcaggggccagagtctgcctgtctatcacatccacaggaactggaactctctctgcccacaataaggacgggtctctgcatatagttctcccatcagagaatgggacaaaagatcagtgtcagatactacatttcactgtgcctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4517 - RNA, 3204 nt, synthetic construct
  misc_feature 1..3204: note = derived and/or modified CDS sequence (wt) from RVFV(2007001811)__EU574040.1__Gn-Gc
  source 1..3204: mol_type = other RNA
atggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctgctagaggcagttcacgacaccatcattgcaaaggctgatccacctagctgtgacctccagagtgctcatgggaatccctgtatgaaagagaaacttgtgatgaagacacattgtcctaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagcatgttcagaactgattcaggcaagctccagaatcaccacttgctccacagagggtgtcaacaccaagtgtagactgtctggcacagcattgatcagggcagggtcagttggggcggaagcttgtttgatgttgaagggggtcaaggaagatcaaaccaagttcttaatgataaaaactgtctcaagtgagctatcgtgcagggagggccagagctattggactgggtcctttagccccaagtgcctgagctcaagaagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctcatag

SEQ ID NO: 4518 - RNA, 3204 nt, synthetic construct
  misc_feature 1..3204: note = derived and/or modified CDS sequence (wt) from RVFV(2007000253)__JF326192.1__Gn-Gc
  source 1..3204: mol_type = other RNA
atggcagggattgcgatgacagtccttccagccttagcagtttttgctttggcaccagttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagctggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4519 - RNA, 3204 nt, synthetic construct
  misc_feature 1..3204: note = derived and/or modified CDS sequence (wt) from RVFV(2007001292)__EU574046.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacggaatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactggatcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatctctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4520 - RNA, 3204 nt, synthetic construct
  misc_feature 1..3204: note = derived and/or modified CDS sequence (wt) from RVFV(2007002476)__EU574036.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcaaatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4521 - RNA, 3204 nt, synthetic construct
  misc_feature 1..3204: note = derived and/or modified CDS sequence (wt) from RVFV(73HB1230)__DQ380221.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcccaagtatgagctcactgaggactgcaacttttgtaggcagatgacaggtgctagcctgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagactaagaaggagctcaaaagctttgatatctctcagtgccccaagattggaggacatggtagtaagaagtgcactggggacgcagcattttgctctgcttatgagtgcactgctcagtacgccaatgcctattgttcgcatgctaatggttcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagtccttctaccgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgctccaaggaaagttctgaatccactaatgtggattacagccttcatcagatgggtgtataagaagatggttgctagagtggcagacaatattaatcaagtgaacagggaaataggatggatggaaggaggtcagttggtcctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgttaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgttggagagtgtcatgtgaataggtgtctgtcttggagggacaatgaaacttcagcagagttttcatttgttggggaaagcacgatcatgcgagagaataagtgttttgagcagtgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacgacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagctgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctgttggtgaaagggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgtctgtatgttgcattatcaattgggctctttttcctccttatatatcttggaagaacaggcctctctaaaatgtggcttgctgctactaagaaggcctcatag

SEQ ID NO: 4522 - RNA, 3204 nt, synthetic construct
  misc_feature 1..3204: note = derived and/or modified CDS sequence (wt) from RVFV(ZINGA J83 R1)__KU978776.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgagaaggggaaattcccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggctgatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttaccttgataagcttgacctcaagactgaggagaatctgctaccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtagttgtgaagagagaactctctgccaagcccatccagagagttgagccttgcacaacttgtataaccaaatgtgagcctcatgggttggttgtccgatcaacagggttcaagatatcatctgcagttgcttgtgctagcggagtttgcgtcacaggatcgcagagtccttccaccgagattacactcaagtatccagggatatcccagtcctctggaggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgccccaaggaaagttctgaatccactaatgtggattacagccttcatcagatgggtgtataggaagatggttgccagagtggcagacaatattaatcaagtgaacagggagataggatggatggaaggaggtcagttggttctagggaaccctgcccctattcctcgtcatgttccaattccacgttatagcacatacctaatgctactactgattgtctcatatgcatcagcatgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggagaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctggagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgagtcatgccttagggcaccaaaccttatctcatacaagcccatgatagatcaattggagtgcacaacaaatctgattgacccctttgttgtatttgagaggggttctctgccacagacaaggaatgacaaaacctttgctgcttcaaaaggaaatagaggtgttcaagctttctctaagggctctgtgcaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctattggtgagggggactctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcttgtatgttgcattatcaattgggctctttttcctcctcatatatcttggaagaacaggcctctctaaaatgtggcttgctgctactaagaaggcctcatag

SEQ ID NO: 4523 - RNA, 3204 nt, synthetic construct
  misc_feature 1..3204: note = derived and/or modified CDS sequence (wt) from RVFV(2008/00101)__HE687306.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggcattctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactacactcctcatttgcctgtatgttgcattatcaattgggctcttcttcctccttatatatcttggaagaacaggcctctctaaaatgtggcttgccgctactaagaaggcctcatag

SEQ ID NO: 4524 - RNA, 3204 nt, synthetic construct
  misc_feature 1..3204: note = derived and/or modified CDS sequence (wt) from RVFV(2007002445)__EU574037.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactatattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctatacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4525 - RNA, 3204 nt, synthetic construct
  misc_feature 1..3204: note = derived and/or modified CDS sequence (wt) from RVFV(ZC-3349)__DQ380207.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctactgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcaggcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagcctttatcagatggatatataagaagatggttgccagagtggcagacaacattaatcacgtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttaaggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctatctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaaccatactcctcatttgcctgtatgttgcattatcaattgggctctttttcctccttatatatcttggaagaacaggcctctctaaaatgtggcttgctgccactaagaaggcctcatag

SEQ ID NO: 4526 - RNA, 3204 nt, synthetic construct
  misc_feature 1..3204: note = derived and/or modified CDS sequence (wt) from RVFV(Kenya 9800523)__DQ380196.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggccagaccaagagggagctcaaaagctttgatatctctcagtgccccaagattggagggcacggtagtaagaagtgcactggggacgcagcattttgctctgcttatgaatgcactgctcagtatgccaatgccttttgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgaacctcatggattggttgtccgatcaacagggttcaagatatcatctgcagttgcttgtgctagcggagtttgcgtcacagggtcgcagagtccttctactgagattacactcaagtatccagggatatcccagtcctctgggggggacataggggttcacatggcacatgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccattaatgtggattacagccttcatcagatgggtgtataagaagatggttgctagagtggcggacaatattaatcaagtgaacagggaaataggatggatggaaggaggtcagttggttctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgaatgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgttattcctgcaatgcaggggccagagtctgcctgtctatcacatccacaggaactggaactctctctgcccacaataaggaggggtctctgcatatagttctcccatcagagaatgggacaaaagatcagtgtcagatactacatttcactgtgcctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4527 - RNA, 3204 nt, synthetic construct
  misc_feature 1..3204: note = derived and/or modified CDS sequence (wt) from RVFV(Entebbe)__DQ380191.1__Gn-Gc
  source 1..3204: mol_type = other RNA
atggcagggattgcaatgacagtccttccagccttagcagtttttgctttggcacctgttgtttttgctgaagaccctcatctcagaaacagaccagggaagggacacaactacattgacgggatgactcaggaggatgccacatgtaaacctgtgacatatgctggggcatgtagcagttttgatgtcttgctcgaaaagggaaaatttcccctcttccagtcgtatgctcatcatagaactctattagaggcagttcacgacaccatcattgcaaaggctgatccacctagctgtgaccttcagagtgctcatgggaatccctgcatgaaagagaaactcgtaatgaagacacactgtccaaatgactaccagtcagctcattacctcaacaatgacgggaaaatggcttcagtcaagtgccctcctaagtatgagctcactgaggactgcaacttttgtaggcagatgacaggtgctagcttgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgacaagcttgacctcaagactgaggaaaatctgctaccagactcatttgtctgcttcgagcataagggacagtacaaaggaacaatggactctggtcagattaagagggagctcaaaagctttgatatctctcagtgccccaagattggaggacatggtagcaagaagtgcactggggacgcagcattttgctctgcttatgagtgtactgctcaatacgccaatgcctattgttcacatgctaatgggtcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctactgagattacactcaagtatccagggatatcccagtcctctgggggagacataggggttcacatggcacatgatgatcagtcagttagctccaaaatagtagctcactgccccccccaggacccgtgcctagtgcatggctgcatagtgtgtgctcatggcttgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcagatgggtgtataagaagatggttgctagagtggcagacaatatcaatcaagtgaacagggaaataggatggatggaaggaggccagttggttctagggaaccctgcccctattcctcgtcatgctccaattccacgttatagcacatacctaatgctgctattgattgtctcatatgcatcagcatgttcagaactaattcaggcaagctccagaatcaccacctgctccacagaaggtgtcaacaccaagtgtaggctgtctggcacagcattaatcagggcagggtcagttggggcagaggcttgtttgatgttaaagggggtcaaggaagaccagaccaagttcttgaagataaaaactgtctcaagtgagctatcgtgtagggagggccagagctattggactgggtcctttagccccaaatgtctgagctcaaggagatgccatcttgtcggagaatgtcatgtgaataggtgtctgtcttggagggacaatgagacttcagcagaattttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtattgattgggtgcataaactcactctagagatcacagactttgatggctctgtttcaacagtagacttgggagcatcatctagccgtttcacaaactggggttcagttagcctctcactggacgcagagggcatttcaggctcaaatagcttctctttcattgagagcccaggcaaagggtatgcaattgttgatgagccattctcagaaattcctcggcaagggttcttgggagagatcaggtgcaattcagaatcttcagtcctgagtgctcatgaatcatgccttagggcaccaaaccttatctcatacaaacccatgatagatcagttggagtgcacaacaaatctgattgatccctttgttgtctttgagaggggttctctgcctcagacaaggaatgacaaaacctttgcagcttcaaaaggaaataggggtgttcaagctttctctaagggctctgtacaagctgatctaactctgatgtttgacaattttgaggtggactttgtgggagcagccgtgtcttgtgatgccgccttcttaaacttgacaggttgctattcctgcaatgcaggggccagagtctgtctgtctatcacatctacaggaactggaactctttctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaggggaccctgatagctattgatccatttgatgataggcgagaagcagggggggaatcaacagttgtgaatccaaaatctggatcttggaacttctttgactggttttctggacttatgagttggtttggagggcctcttaagactatactcctaatttgcctgtatgtagcattatcaattgggctctttttccttcttatatatcttggaagaacaggtctctccaaaatgtggcttgctgccactaagaaagcttcatag

SEQ ID NO: 4528 - RNA, 3204 nt, synthetic construct
  misc_feature 1..3204: note = derived and/or modified CDS sequence (wt) from RVFV(25010-24)__KM210509.1__Gn-Gc
  source 1..3204: mol_type = other RNA
atggcagggattgcaatgacagtccttccagccttagcagtttttgctttggcacctgttgtctttgccgaagaccctcatcttagaaacaggccaggaaagggacacaactacattgacgggatgactcaggaggatgccacatgtaaacctgtgacatatgctggggcatgtagcagttttgatgtcttgctcgaaaagggaaaatttcccctcttccagtcatacgctcatcatagaactctactagaggccgtccacgacaccattattgcaaaggctgatccacctagctgtgaccttcagagtgctcatgggaatccctgcatgaaggagaaactcgtgatgaagacacactgtccaaatgactaccagtcagctcattaccttaacaatgacgggaaaatggcctcagtcaagtgccctcctaagtatgagctcactgaggactgcaacttttgtaggcagatgacaggtgctagcctgaagaaagggtcttatcctctccaggacttattttgtcagtcaagtgaggatgatgggtcaaaattaaaaacaaaaatgaaaggggtctgcgaagtgggagttcaagcactcaaaaagtgtgatggccaactcagcactgcacatgaggttgtgccctttgcagtatttaagaactcaaagaaggtttatcttgacaagcttgacctcaagactgaggaaaatctgctaccagactcatttgtctgcttcgagcataaggggcagtataaaggaacaatggactctggtcagacaaagagggagctcaaaagctttgatatctctcagtgtcccaagattggagggcatggtagcaagaaatgtactggggacgcagcattctgctctgcttatgagtgcactgctcaatacgccaatgcctattgttcacatgctaatgggtcaggaattgtacagatacaagtatccggggtctggaagaagcctttgtgtgtagggtatgagagagtggttgtgaagagagagctctctgccaagcccatccagagagttgagccttgcacaacttgtataaccaaatgtgagcctcatggattaattgtccgatcaacagggttcaagatatcatctgcagttgcttgtgctagcggagtttgcgtcacaggatcgcagagcccgtctactgagatcacactcaagtacccagggatatcccagtcctctgggggggacataggggttcacatggcacatgatgatcagtcagttagctccaaaatagtagctcactgccccccccaggacccgtgcctagtgcatggctgcatagtgtgtgctcatggcttgataaattaccagtgtcacactgctctcagtgcctttgtcgttgtgttcgtgttcagctctgttgcaataatttgtttggctattctttataaggtgctcaagtgcctaaaaattgccccaaagaaagttctaaatccactgatgtggattactgctttcatcagatgggtgtataagaagatggttgccagagtggcagacaatatcaatcaagtgaacagggaaataggatggatggaaggaggccagttagctctagggaatcctgctcctatccctcgtcatgctccaattccacgttatagcacatacctaatgctactattgattgtctcatatgcatcagcatgttcagaactgattcaggccagctccagaatcactacttgctccacagaaggtgttaacactaagtgtaggctgtctggcacagcattgatcagggcaggatcagttggagcagaagcttgtctgatgttaaagggggtcaaggatgaccaaaccaagttcctgaagataaaaactgtctcaagtgagctatcgtgcagggagggccagagctattggactgggtccttcagccccaaatgtctgagctcaaggaggtgccatcttgtcggggaatgtcatgtgaataggtgtctgtcttggagggacaatgagacttcagcagaattttcatttgttggggaaagcacgaccatgcgagagaacaagtgttttgagcagtgtggaggatggggatgtgggtgtttcaacgtaaacccatcttgcttgtttgtgcacacgtatctacagtcagtcagaaaagaggcccttagagtttttaactgcattgattgggtgcataaacttactctagagatcacagactttgatggctctgtttcaacaatagacttgggagcttcatctagccgtttcacaaactggggttcagttagcctctcactggacgcagagggcatttcaggctcaaatagcttttctttcattgagagcccaggcaaagggtatgcaattgttgatgagccattctcagaaattcctcggcaaggattcttaggagagatcaggtgcaattcagaatcttcagttctgagtgctcatgaatcatgccttagggcgccaaaccttatctcatacaaaccaatgatagatcagttggagtgcacaacaaatctaattgatccttttgtagtctttgagaggggttccctgccacaaacaaggaatgacaaaacctttgcagcttcaaaagggaataggggtgttcaagctttctctaagggctctgtacaagctgatctaactctgatgtttgacaattttgaggtggacttcgtgggagcagccgtgtcttgtgatgccgccttcttgaatttgacaggttgctattcatgcaatgcaggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaagggaccctgatagctattgatccatttgatgataggcgagaagcagggggggaatcaacagttgtgaatccaaaatctggatcttggaatttctttgactggttttctggactcatgagttggtttggagggcctctcaagactatactcctaatttgcctgtatgtagcattatcaattgggctctttttccttcttatatatcttgggagaacaggtctctctaaaatgtggcttgctgctactaagaaggcctcatag

SEQ ID NO: 4529 - RNA, 3204 nt, synthetic construct
  misc_feature 1..3204: note = derived and/or modified CDS sequence (wt) from RVFV(763/70)__DQ380188.1__Gn-Gc
  source 1..3204: mol_type = other RNA
atggcagggattgcaatgacagtccttccagccttagcagtttttgctttggcacctgttgtttttgctgaagaccctcatctcagaaacagaccagggaaggggcacaactacattgacgggatgactcaggaggacgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccctgcatgaaggagaaactcgtgatgaagacacactgtccaaatgactaccagtcagctcattacctcaacaatgacgggaaaatggcttcagtcaagtgccctcctaaatatgggctcactgaggactgcaatttttgcaggcagatgacaggtgctagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctcaaaagctttgatatctctcagtgccccaagattggaggacatggtagcaagaagtgcactggggacgcagctttttgctctgcttatgagtgcactgctcaatacgccaatgcttattgttcacatgctaatgggtcaggaattgtacagatacaagtatccggggtctggaagaagcctttgtgtgtcgggtatgagagggtggttgtgaagagagaactctctgctaagcccatccagagagttgagccttgcacaacttgtataaccaaatgtgagcctcacggattggttgtccgatcaacaggtttcaagatatcatctgcagttgcttgtgctagcggagtttgcgttacaggatcgcagagcccttctaccgagatcacactcaagtatccagggatatcccagtcctctgggggggacataggggttcacatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctgaatccactaatgtggattactgctttcatcagatgggtgtataagaagatggttgccagagtggcagacaatatcaatcaggtgaacagggaaataggatggatggaaggaggccagctggctctagggaaccctgcccctattcctcgtcatgctccaattccacgttatagcacatacttaatgctactattgattgtctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagagacaatgaaacctcagcagaattttcatttgttggggaaagcacgaccatgcgggagaataagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgacggctctgtttcaacaatagacctgggagcatcatctagccgtttcacaaactggggttcagttagcctctcactggacgcagagggcatttcaggctcaaacagcttttccttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaatcttatttcatacaagcccatgatagatcagttggagtgcacaacaaatctgattgatccctttgttgtctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatgggtctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttccttcttatatatcttggaagaacaggcctctctaaaatgtggcttgctgccaccaagaaagcctcatag

SEQ ID NO: 4530 - RNA, 3204 nt, synthetic construct
  misc_feature 1..3204: note = derived and/or modified CDS sequence (wt) from RVFV(OS-1)__DQ380186.1__Gn-Gc
  source 1..3204: mol_type = other RNA
atggcagggattgcaatgacagtccttccagccttagcagtttttgctttggcacctgttgtatttgctgaagacccccatctcagaaatagaccagggaaggggcacaactacattgacgggatgactcaggaggatgccacttgtaaacctgtgacatatgctggggcatgtagcagttttgatgtcttgctcgaaaagggaaaattccccctcttccagtcgtatgctcatcatagaactctactagaggcagttcatgacaccatcattgcaaaggctgatccacctagttgtgatcttcagagtgctcatgggaatccttgcatgaaagagaaactcgtgatgaagacacactgtccaaatgactaccagtcagcccactacctcaacaatgatgggaaaatggcctcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaggcactcaagaagtgtgatggccagctcagcactgcacatgaggttgtgccctttgcagtgtttaagaactcaaagaaggtttatcttgacaagcttgacctcaaaactgaagaaaatctgctaccagactcatttgtctgcttcgagcataagggacagtataaaggaacaatggactctggtcaaactaagagggagctcaaaagctttgatatctctcagtgccccaagattggaggacatggtagcaagaagtgcactggggacgcagcattttgctctgcttatgagtgcactgctcaatacgccaatgcctattgttcacatgctaatgggtcaggagttgtgcagatacaagtatccggggtctggaagaaacctttatgtgtagggtatgagagagtggttgtgaagagagaactctctgccaaacccatccagagagttgagccttgcacaacctgtataaccaaatgtgagcctcatggattggttgtccgatcaacagggttcaagatatcatctgcagttgcatgtgctagcggagtttgtgtcacaggatcgcagagtccttctaccgagatcacactcaagtatccagggatatcccagtcctctgggggggacataggggttcacatggcacacgatgatcagtcagttagctccaaaatagtagctcactgccctccccaggacccgtgcctagtgcatggctgcatagtgtgtgctcatggcctaataaattaccagtgtcacactgctctcagtgcctttgttgttgtgttcgtattcagctctgttgcaataatttgtttggccattctttataaggtgctcaagtgcctaaagattgccccaaggaaagttctaaatccactaatgtggattactgccttcatcagatgggtgtataagaagatggttgccagggtggcagacaatattaatcaagtgaacagagaaataggatggatggagggaggtcagttggctctagggaaccctgcccctattcctcgtcatgccccaattccacgttatagcacatacctgatgctactattgattgtctcatatgcatcagcatgttcagaactgattcaggcaagctctagaataaccacttgctctacagaaggtgtcaacaccaagtgtaggctgtctggcacagcattaatcagggcagggtcagttggggcagaggcttgcttgatgttaaagggagtcaaggaggaccaaacaaagttcttgaagataaaaactgtctcaagtgagctatcgtgcagggaaggccagagctattggactggatcctttagtcccaaatgtctgagctcaaggagatgccatcttgtcggggaatgtcatgtgaataggtgtctgtcttggagggacaatgaaacttcagcagagttttcatttgttggggaaagcacgactatgcgagagaataaatgttttgagcagtgtgggggatggggatgtgggtgcttcaatgtgaacccatcttgcttgtttgtgcacacgtatctgcagtcagttagaaaagaggcccttaaagtttttaactgtatcgattgggtgcataaactcactctagagatcacagactttgatggttctgtttcaacaatagacttgggagcatcatctagccgtttcacaaactggggctcagttagcctctcactggatgcagagggcatttcaggctcaaatagcttttctttcattgagagcccaggcaaagggtatgcaattgttgatgagccattctcagaaatccctcggcaagggttcttgggggagatcaggtgcaattcagaatcttcagtcctgagtgctcatgaatcatgccttcgggcaccaaacctcatctcatacaagcccatgatagaccagttggagtgcacaacaaatctgattgatccctttgttgtctttgagaggggttctctgcctcagacaaggaatgataaaacttttgcagcttcaaaaggaaataggggtgttcaagctttctctaagggctctgtacaagctgatttaactctgatgtttgacaattttgaggtggactttgtgggagcagccgtgtcttgtgatgccgctttcttaaatctgacaggttgttattcttgtaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatcgccattgatccatttgatgacaggcgggaagcagggggagaatcaacagttgtgaatccaaaatctggatcttggaatttctttgactggttttctggactcatgagttggtttggagggcctcttaagactatactcctcatttgcctgtatgttgcattatcaattgggctctttttccttctcatatatcttggaagaacaggtctctctaaaatgtggcttgctgctactaagaaggcctcataa

SEQ ID NO: 4531 - RNA, 3204 nt, synthetic construct
  misc_feature 1..3204: note = derived and/or modified CDS sequence (wt) from RVFV(BIME-01)__KX609032.1__Gn-Gc
  source 1..3204: mol_type = other RNA
atggcagggattgcaatgacagttcttcccgccttagcagtttttgctttggcacctgttgtttttgctgaggaccctcatctcagaaacagaccagggaagggacataactacattgacgggatgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgatccacctagctgtgatctccagagtgctcatgggaatccctgcatgaaagagaaactcgtgatgaagacacactgtccaaatgactaccagtcagctcattacctcaacaatgacgggaaaatggcttcagtcaagtgccctcctaagtatgagcttactgaggactgcaacttttgtaggcagatgacaggtgctagcttgaagaaggggtcttatcctctccaggacttattttgtcagtcaagtgaggatgatggatcaaaactaaagacaaaaatgaaaggggtctgcgaagtgggggttcaggcactcaaaaagtgtgatggccaactcagcactgcacatgaggttgtgccctttgcagtgtttaagaattcaaagaaggtttatcttgacaagcttgaccttaagactgaagaaaatctgctaccagactcatttgtctgctttgagcataagggacagtataaaggaacaatggactctggtcagactaagagggagctcaaaagctttgatatctctcagtgccccaagattgggggacatggtagcaagaagtgcactggggacgcagcattttgctctgcttatgagtgtactgctcaatatgccaatgcctattgttcacatgctaatgggtctgggattgtacagatacaagtatccggggtctggaagaagcctttatgtgtggggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgccagcggagtttgcgtcacaggatcgcagagcccttctactgagatcactctcaagtatccagggatatcccagtcctctgggggggatataggggttcacatggcacatgatgatcagtcagttagctccaaaatagtggctcactgccccccccaggacccgtgcctagtgcatggctgcatagtgtgtgctcatggcttgataaattaccagtgtcacactgctcttagtgcttttgttgttgtgttcgtattcagctctgttgcaataatttgtctggccattctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgctcccattcctcgtcatgctccgattccacgttatagcacatacctaatgctactattgattatctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttaatgttaaagggggtcaaggaagaccagaccaagttcttgaagataaaaactgtctcaagtgagctatcgtgcagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtggatgtttcaatgtgaacccatcttgcttatttgtgcacacgtatctgcaatcagttagaaaagaggctcttagagtttttaactgtattgattgggtgcataaactcactctagagatcacagactttgatggctctgtttcaacaatagacttgggagcatcatctagccgtttcacaaactggggctcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttctgtcctgagtgctcatgagtcatgccttagggcaccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaaaggctctgtacaggctgatctaactctgatgtttgacaattttgaggtggactttgtgggagcagccgtgtcttgtgatgccgccttcttaaatttgacaggttgctattcctgcaatgctggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagttcatgtactcttgtgatggagatgagcgacctttgttggtgaaggggaccctaatagctattgatccatttgatgataggcgagaagcagggggagaatcaacagttgtgaatccaaaatctggatcttggaacttctttgactggttttctggacttatgagttggtttggaggacctcttaagactatactcctaatttgcctgtatgtagcattatcaattgggctctttttccttcttatatatcttggaagaacaggtctctctaaaatgtggcttgctgccactaagaaagcctcatag

SEQ ID NO: 4532 - RNA, 3204 nt, synthetic construct
  misc_feature 1..3204: note = derived and/or modified CDS sequence (wt) from RVFV(73HB1449)__DQ380211.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcccctcttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcacagaggactgcaacttttgtaggcagatgacaggtgctagcctgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcacaagggacagtataagggaacaatggactctggtcagactaagagggagctcaaaagctttgatatttctcagtgccccaagattggaggacatggtagtaagaagtgcactggggacgcagcattttgctctgcttatgagtgcactgctcagtatgccaatgcttattgttcacatgctaatgggtcagggattgtgcagatacaagtatcaggggtctggaagaagcctttatgtgtagggtatgagagagtggttgtgaagagagaactctctgccaagcccatccagagggttgagccttgcacaacttgtataaccaaatgtgagcctcatggattggttgtccgatcaacagggttcaagatatcatctgcagttgcttgtgctagcggagtttgcgtcacaggatcgcagaatccttccaccgagatcacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgttcgtgttcagttctattgcaataatttgtttagctattctttatagggtgctcaagtgcctaaagattgccccaaggaaagttctgaatccactaatgtggattacagccttcatcagatgggtgtataagaagatggttgccagagtggcagacaatattaatcaagtgaatagggaaataggatggatggaaggaggtcagttggtcctagggaaccctgcccctattcctcgccatgccccaattccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtctgatgttgaagggggtcaaggacgatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactaacactagagatcacagactttgatggctctgtttcaacaatagacctaggagcatcatctagccgtttcacaaactggggttcagtcagcctctcactggacgcagagggcatttcaggctcaaatagcttttctttcattgagagcccaggcaaagggtatgcaattgttgatgagccattctcagaaattcctcggcaagggttcctgggggagatcaggtgcaattcagagtcctcagtcctgagtgctcatgaatcatgccttagggcaccaaaccttatctcatacaagcccatgatagaccaattggagtgcacaacgaatctgattgatccatttgttgtctttgagaggggttctctgccacagacaaggaatgaaaaaacctttgcagcttcaaaaggaaatagaggtgtccaagccttctctaagggctctgtacaagctgatctaactctgatgtttgacaattttgaggtggattttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcaatgccagatactacacttcactgtacctgaggtagaggaggagtttatgtactcttgtgacggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactccttatttgcctgtatgttgcattatcaattgggctctttttcctcctcatatatcttggaagaacaggcctctctaaaatgtggcttgctgctactaagaaggcctcatag

SEQ ID NO: 4533 - RNA, 3204 nt, synthetic construct
  misc_feature 1..3204: note = derived and/or modified CDS sequence (wt) from RVFV(SA01-1322)__KX096942.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcctcttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtaggagttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggccagaccaagagggagctcaaaagctttgatatctctcagtgccccaagattggagggcatggtagtaagaagtgcactggggacgcagcattttgctctgcttatgaatgcactgctcagtatgccaatgccttttgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgaacctcatggattggttgtccgatcaacagggttcaagatatcatctgcagttgcttgtgctagcggagtttgcgtcacagggtcgcagagtccttctactgagattacactcaagtatccagggatatcccagtcctctgggggggacataggggttcacatggcacatgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccattaatgtggattacagccttcatcagatgggtgtataagaagatggttgctagagtggcggacaatattaatcaagtgaacagggaaataggatggatggaaggaggtcagttggttctaggggaccctgcccctattcctcgtcatgccccaatcccacgttatagcacatacctaatgctgctattgattatctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggagtcaaggaagatcaaaccaagttcttaaagataaaaactgtctctagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggtaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgttattcctgcaatgcaggggccagagtctgcctgtctatcacatccacaggaactggaactctctctgcccacaataaggacgggtctctgcatatagttctcccatcagagaatgggacaaaagatcagtgtcagatactacatttcactgtgcctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggacttatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4534 - RNA, 3204 nt, synthetic construct
  misc_feature 1..3204: note = derived and/or modified CDS sequence (wt) from RVFV(Sudan 2V-2007)__JQ820490.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgacctccagagtgctcatgggaatccctgtatgaaagagaaacttgtgatgaagacacattgtccaaatgactaccagtcagctcattacctcaacaatgacgggaaaatggcctcagtcaagtgcccacctaagtatgagctcactgaggactgcaacttttgtagacagatgacaggtgctagcctgaagaaggggtcttatcctctccaagacttattttgtcagtcgagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtctatcttgataagcttgacctcaagactgaggagaatctgctaccagactcatttgtctgcttcgagcataagggacagtataaaggaacaatggactctggtcagaccaagagggagctcaagagctttgatatctctcagtgccccaagattggagggcatggtagtaagaagtgcactggggatgcagcattttgctctgcttatgaatgcactgctcagtatgccaatgcctattgttcacatgctaatgggtcagggattgtgcagattcaagtatcaggggtctggaagaaacctttgtgtgtagggtatgagagagtggttgtgaagagagaactctctgccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggatataggggttcacatggcacacgatgatcagtcagttagctccaaaatagtagctcactgccccccccaggacccgtgctcagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccctgcccctattcctcgtcatgccccaatcccacgttatagcacatacctaatgctactattgattgtctcacatgcatcagcatgttcagaacttattcaggcaagctccagaatcaccacttgctccacagagggtgtcaacaccaagtgtagactgtctggcacagcattgatcagggcagggtcagttggggcggaggcttgtttgatgttgaagggggtcaaggaagatcaaactaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtaaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggtttttgggggagatcaggtgcaattcagagtcctcagtcctaagtgctcatgaatcatgccttagggcgccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaagacgggtctctgcatatagttctcccatcagagaatgggacaaaagatcagtgtcagatactacattttactgtacctgaagtagaagaggagtttatgtactcttgtgatggagatgagcggcctctgttagtaaaagggaccctgatggctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4535 - RNA, 3204 nt, synthetic construct
  misc_feature 1..3204: note = derived and/or modified CDS sequence (wt) from RVFV(35/74)__JF784387.1__Gn-Gc
  source 1..3204: mol_type = other RNA
atggcagggattgcaatgacagtccttccagccttagcagtttttgctttggcacctgttgtttttgctgaagaccctcatctcagaaacagaccagggaaggggcacaactacattgacgggatgactcaggaggacgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccctgcatgaaggagaaactcgtgatgaagacacactgtccaaatgactaccagtcagctcattacctcaacaatgacgggaaaatggcttcagtcaagtgccctcctaaatatgagctcactgaggactgcaatttttgcaggcagatgacaggtgctagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctcaaaagctttgatatctctcagtgccccaagattggaggacatggtagcaagaagtgcactggggacgcagctttttgctctgcttatgagtgcactgctcaatacgccaatgcttattgttcacatgctaatgggtcaggagttgtacagatacaagtatccggggtctggaagaagcctttgtgtgtcgggtatgagagggtggttgtgaagagagaactctctgctaagcccatccagagagttgagccttgcacaacttgtataaccaaatgtgagcctcacggattggttgtccgatcaacaggtttcaagatatcatctgcagttgcttgtgctagcggagtttgcgttacaggatcgcagagcccttctaccgagattacactcaagtatccagggatatcccagtcctctgggggggacataggggttcacatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctggatccactaatgtggattactgttttcatcagatgggtgtataagaagatggttgccagagtagcagacaatatcaatcaggtgaacagggaaataggatggatggaaggaggccagctggctctagggaaccctgcccctattcctcgtcatgctccaattccacgttatagcacatacctaatgctactattgattgtctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagagacaatgaaacctcagcagaattttcatttgttggggaaagcacgaccatgcgggagaacaagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgatggctctgtttcaacaatagacctgggagcatcatctagccgtttcacaaactggggttcagttagcctctcactggacgcagagggcatttcaggctcaaacagcttttccttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaatcttatttcatacaagcccatgatagatcagttggagtgcacaacaaatctgattgatccctttgttgtctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatggatctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttccttcttatatatcttggaagaacaggcctctctaaaatgtggcttgctgccaccaagaaagcctcatag

SEQ ID NO: 4536 - RNA, 3204 nt, synthetic construct
  misc_feature 1..3204: note = derived and/or modified CDS sequence (wt) from RVFV(200803169)__JF311384.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgacccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgacatctctcagtgccccaagattggagggcatggtagtaagaagtgcactggggacgcagcattctgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggtagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagattcctcggcaagggttcttgggggaggtcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4537 - RNA, 3204 nt, synthetic construct
  misc_feature 1..3204: note = derived and/or modified CDS sequence (wt) from RVFV(2269/74)__DQ380222.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgtaaacctgtgacatatgctggggcatgtagcagttttgatgtcttgctcgaaaaggggaaattccccctcttccagtcgtatgctcatcatagaactctactagaggcagttcacgacactatcattgcaaaggctgacccacctagctgtgaccttcagagtgctcatgggaatccctgcatgaaagagaagctcgtgatgaagacacactgtccaaatgactaccaatcagctcattaccttaacaatgacgggaaaatggcttcagtcaagtgcccccctaagtatgagctcactgaggattgcaacttttgtaggcagatgacaggtgctagcctgaagaaggggtcttatcctctccaggacttattttgtcagtcaagtgaggatgatgggtcaaaattaaaaacaaaaatgaaaggggtctgcgaagtgggagttcaagcactaaaaaagtgtgatggccaactcagcactgcacatgaggttgtgcccttcgcagtgtttaagaactcaaagaaggtttatcttgataagcttgaccttaagactgaggaaaatctgctaccagactcatttgtctgcttcgagcataaaggacaacataaaggaacaatggactctggtcagaccaagagggagctcaaaagctttgatatctctcagtgccccaagattggaggacatggtagcaagaagtgcactggggacgcagcattttgctctgcttatgagtgcactgctcagtacgccaatgcctattgttcacatgctaatgggtcaggaattgtgcagatacaagtgtcaggggtctggaagaagcctttatgtgtagggtatgagagagtggttgtaaagagagaactctctgccaagcccatccagagagttgagccttgcacaacttgtataaccaaatgcgagcctcatggactggttgtccgatcaacagggttcaagatatcatctgcagttgcttgtgctagcggagtttgcgtcacaggatcgcagagtccttctaccgagattacactcaagtatccaggaatatctcagtcctctgggggggacataggggttcacatggcacacgacgatcagtcagttagctccaaaatagtagctcactgccccccccaggacccgtgcttagtgcatggctgcatagtgtgtgctcatggcctgataaattaccagtgtcacactgctctcagtgcctttgttgttgtgttcgtgttcagctctgttgcaataatttgtttggccattctttataaggtgctcaagtgcctaaagattgccccaaagaaagttctgaatccgctaatgtggattactgccttcatcagatgggtatataagaagatggttgccagagtggcagataatataaatcaagtgaacagggaaataggatggatggaaggaggtcagttggctctagggaaccctgcccctattcctcgtcacgctccaatcccacgctatagcacatacctaatgctactactgattgtctcatatgcgtcagcatgttcagaactgattcaggcaagctctaggattaccacttgctccacagaaggtgtcaacaccaagtgtaggctgtctggcacagcattaattagggcagggtcagttggggcagaggcttgtttgatgttaaagggggtcaaggaagaccaaaccaagttcttgaagataaaaactgtctcaagtgagctatcgtgcagggagggccagagctactggactgggtcctttagccccaaatgtctgagctcaaggagatgccatcttgtcggggaatgtcatgtgaataggtgcttgtcttggagggacaatgaaacttcagcagagttttcatttgttggggaaagcacgaccatgcgagagaataagtgttttgagcagtgtggaggatggggatgtgggtgtttcaatgtgaacccatcttgcttatttgtgcacacgtacctgcagtcagttagaaaagaggcccttagagtttttaactgtatcgattgggtgcataaactcactctagagatcacagactttgatggctctgtttcaacaatagacttgggagcatcatctagccgtttcacaaactggggttcagttagcctctcactggacgcagagggcatttcaggctcaaatagcttttcattcattgagagcccaggcaaagggtatgcaattgttgatgagccattctcagaaattcctcggcaagggttcctgggggagatcaggtgcaactcagaatcttcagtcctgagtgctcatgaatcatgccttagggcaccaaaccttatctcatacaagcctatgatagatcagttggagtgcacaacaaatctgattgatccctttgttgtctttgagaggggttctctgccacagacaagaaatgacaaaacttttgcagcttcaaaaggaaataggggtgttcaagctttctctaagggctctgtgcaagctgatctaactctgatgtttgacaattttgaggtggactttgtgggagcagccgtgtcttgtgatgccgccttcttaaatttgacaggttgctattcttgcaatgcaggggccagggtctgcctgtctatcacatccacaggaactggaactctctctgcccacaacaaggatgggtctctgcatatagttctcccatcagaaaatggaacaaaagatcagtgtcagatactacacttcactgtgcctgaggtagaggaggagtttatgtactcttgtgatggagatgagcggcctttgttagtgaaggggaccctgatagccattgatccatttgatgataggcgggaagcaggaggggaatcaacagttgtgaatccaaaatctggatcttggaatttctttgactggttctctggactcatgagttggtttggagggcctcttaagaccatactcctcatatgcctgtatgttgcattatcaattgggctctttttccttcttatatatcttggaagaacaggtctctctaaaatgtggcttgctgctactaagaaggcttcatag

SEQ ID NO: 4538 - RNA, 3204 nt, synthetic construct
  misc_feature 1..3204: note = derived and/or modified CDS sequence (wt) from RVFV(SA-51 (Van Wyck))__DQ380195.1__Gn-Gc
  source 1..3204: mol_type = other RNA
atggcagggattgcaatgacagtccttccagccttagcagtttttgctttggcacctgttgtttttgctgaagacccccatctcagaaacagaccagggaagggacacaactacattgacgggatgactcaggaggatgccacatgtaaacctgtgacatatgctggggcatgtagcagttttgatgtcttgctcgaaaagggaaaatttcccctttttcagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaacgacgggaaaatggcttcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaaaactgaggaaaatctgctaccagactcatttgtctgcttcgagcataagggacagtataaaggaacaatggactctggtcagactaagagggagctcaagagctttgatatctctcagtgccccaagattggaggacgtggtagcaagaagtgcactggggacgcagcattttgctctgcttatgagtgcactgctcaatacgccaatgcctattgttcacatgctaatgggtcaggaattgtgcagatacaagtatcaggggtctggaagaagcctttatgtgtaggatatgagagagtggttgtgaaaagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctacagagattacactcaagtacccagggatatcccagtcctctggaggggacataggggttcacatggcacacgatgatcagtcagttagctccaaaatagtagctcactgccccccccaagacccgtgcttagtgcatggctgcatagtgtgtgctcatggcctgataaattaccagtgtcacactgctctcagtgcctttgttgttgtgttcgtattcagctctgttgcaataatctgtttagccattctttataaggtgctcaagtgcctaaagattgccccaaggaaagttctgaatccactaatgtggattactgccttcatcagatgggtgtataagaagatggttgccagagtggcagacaatattaatcaagtgaacagggagataggatggatggaaggaggtcagttggctctagggaatcctgcccctattcctcgtcatgctccaattccacgttatagcacatacctaatgctactattgattgtctcatatgcatcagcatgctcagaactgattcaggcaagctccagaatcaccacttgctctacagaaggtgtcaacaccaagtgtaggctgtctggcacagcattaatcagggcagggtcagttggggcagaggcttgtttgatgttgaagggggtcaaggaagaccaaaccaagttcttgaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggataatgaaacttcagcagagttttcatttgttggggaaagcacgaccatgcgagaaaataagtgttttgagcagtgtggaggatggggatgtgggtgtttcaatgtgaacccatcttgcttatttgtgcacacgtatctgcagtcagttagaaaagaggcccttagagtttttaactgtatcgattgggtgcataaactcactctggaggtcacagattttgatggctctgtttcaacaatagacttgggagcatcatctagccgtttcacaaactggggttcagttagcctctcactggatgcagagggcatttcaggctcaaatagcttttctttcattgagagcccaggcaaagggtatgcaattgttgatgagccattctcagaaattcctcggcaagggttcttgggggagatcaggtgcaattcagaatcttcagttctgagtgcccacgaatcatgccttagggcaccaaaccttatctcatacaagcccatgatagatcagttggagtgcacaacaaatctgattgatccctttgttgtctttgagaggggttccctgccacagacaaggaatgacaaaacctttgcagcttcaaaaggaaacaggggtgttcaagctttctctaagggctctgtacaagctgatctaactctgatgtttgacaattttgaggtggactttgtgggagcagccgtgtcttgtgatgctgccttcttaaatttgacagggtgctattcttgcaatgcaggggccagggtctgcctgtctatcacatccacaggaactggaaccctctctgcccacaataaggatgggtctctgcatatagttcttccatcagagaatggaacaaaagatcagtgtcagatactacacttcactgttcctgaagtagaggaagagtttatgtactcttgtgatggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttccttcttatatatcttggaagaacaggtctttctaaaatgtggcttgctgctactaagaaggcctcatag

SEQ ID NO: 4539 - RNA, 3204 nt, synthetic construct
  misc_feature 1..3204: note = derived and/or modified CDS sequence (wt) from RVFV(OS-8)__DQ380185.1__Gn-Gc
  source 1..3204: mol_type = other RNA
atggcagggattgcaatgacagtccttccagccttagcagtttttgctttggcacctgttgtatttgctgaagacccccatctcagaaatagaccagggaaggggcacaactacattgacgggatgactcaggaggatgccacttgtaaacctgtgacatacgctggggcatgtagcagttttgatgtcttgctcgaaaagggaaaattccccctcttccagtcgtatgctcatcatagaactctactagaggcagttcatgacaccatcattgcaaaggctgatccacctagttgtgatcttcagagtgctcatgggaatccttgcatgaaagagaaactcgtgatgaagacacactgtccaaatgactaccagtcagcccactacctcaacaatgatgggaaaatggcctcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaggcactcaagaagtgtgatggccagctcagcactgcacatgaggttgtgccctttgcagtgtttaagaactcaaagaaggtttatcttgacaagcttgacctcaaaactgaagaaaatctgctaccagactcatttgtctgcttcgagcataagggacagtataaaggaacaatggactctggtcaaactaagagggagctcaaaagctttgatatctctcagtgccccaagattggaggacatggtagcaagaagtgcactggggacgcagcattttgctctgcttatgagtgcactgctcaatacgccaatgcctattgttcacatgctaatgggtcaggagttgtgcagatacaagtatccggggtctggaagaaacctttatgtgtagggtatgagagagtggttgtgaagagagaactctctgccaaacccatccagagagttgagccttgcacaacctgtataaccaaatgtgagcctcatggattggttgtccgatcaacagggttcaagatatcatctgcagttgcatgtgctagcggagtttgtgtcacaggatcgcagagtccttctaccgagatcacactcaagtatccagggatatcccagtcctctgggggggacataggggttcacatggcacacgatgatcagtcagttagctccaaaatagtagctcactgccccccccaggacccgtgcctagtgcatggctgcatagtgtgtgctcatggcctaataaattaccagtgtcacactgctctcagtgcctttgttgttgtgttcgtattcagctctgttgcaataatttgtttggccattctttataaggtgctcaagtgcctaaagattgccccaaggaaagttctaaatccactaatgtggattactgccttcatcagatgggtgtataagaagatggttgccagggtggcagacaatattaatcaagtgaacagagaaataggatggatggagggaggtcagttggctctagggaaccctgcccctattcctcgtcatgccccaattccacgttatagcacatacctgatgctactattgattgtctcatatgcatcagcatgttcagaactgattcaggcaagctctagaataaccacttgctccacagaaggtgtcaacaccaagtgtaggctgtctggcacagcattaatcagggcagggtcagttggggcagaggcttgcttgatgttaaagggagtcaaggaggaccaaacaaagttcttgaggataaaaactgtctcaagtgagctatcgtgcagggaaggccagagctattggactggatcctttagtcccaaatgtctgagctcaaggagatgccatcttgtcggggaatgtcatgtgaataggtgtctgtcttggagggacaatgaaacttcagcagagttttcatttgttggggaaagcacgactatgcgagagaataaatgttttgagcagtgtgggggatggggatgtgggtgcttcaatgtgaacccatcttgcttgtttgtgcacacgtatctgcagtcagttagaaaagaggcccttagagtttttaactgtatcgattgggtgcataaactcactctagagatcacagactttgatggttctgtttcaacaatagacttgggagcatcatctagccgtttcacaaactggggctcagttagcctctcactggatgcagagggcatttcaggctcaaatagcttttctttcattgagagcccaggcaaagggtatgcaattgttgatgagccattctcagaaatccctcggcaagggttcttgggggagatcaggtgcaattcagaatcttcagtcctgagtgctcatgaatcatgccttcgggcaccaaacctcatctcatacaagcccatgatagaccagttggagtgcacaacaaatctgattgatccctttgttgtctttgagaggggttctctgcctcagacaaggaatgataaaacttttgcagcttcaaaaggaaataggggtgttcaagctttctctaagggctctgtacaagctgatttaactctgatgtttgacaattttgaggtggactttgtgggagcagccgtgtcttgtgatgccgctttcttaaatctgtcaggttgttattcttgtaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatcgccattgatccatttgatgacaggcgggaagcagggggagaatcaacagttgtgaatccaaaatctggatcttggaatttctttgactggttttctggactcatgagttggtttggagggcctcttaagactatactcctcatttgcctgtatgttgcattatcaattgggctctttttccttctcatatatcttggaagaacaggtctctctaaaatgtggcttgctgctactaagaaggcctcataa

SEQ ID NO: 4540 - RNA, 3204 nt, synthetic construct
  misc_feature 1..3204: note = derived and/or modified CDS sequence (wt) from RVFV(KEN07-KUR340)__EF460404.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgacccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgacatctctcagtgccccaagattggagggcatggtagtaagaagtgcactggggacgcagcattctgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttataggatgctcaagtgcttaaagattgccccaaggatagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcgtctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4541 - RNA, 3204 nt, synthetic construct
  misc_feature 1..3204: note = derived and/or modified CDS sequence (wt) from RVFV(ANK-3837)__DQ380215.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgagaaggggaaattcccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttaccttgataagcttgacctcaagactgaggagaatctgctaccagactcatttgtctgcttcgagcataagggacagtataaaggaaaattggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtagttgtgaagagagaactctctgccaagcccatccagagagttgagccttgcacaacttgtataaccaaatgtgagcctcatgggttggttgtccgatcaacagggttcaagatatcatctgcagttgcttgtgctagcggagtttgcgtcacaggatcgcagagtccttccaccgagattacactcaagtatccagggatatcccagtcctctggaggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgccccaaggaaagttctgaatccactaatgtggattacagccttcatcagatgggtgtataggaagatggttgccagagtggcagacaatattaatcaagtgaacagggagataggatggatggaaggaggtcagttggttctagggaaccctgcccctattcctcgtcatgttccaattccacgttatagcacatacctaatgctactactgattgtctcatatgcatcagcatgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggagaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctggagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgagtcatgccttagggcaccaaaccttatctcatacaagcccatgatagatcaattggagtgcacaacaaatctgattgacccctttgttgtatttgagaggggttctctgccacagacaaggaatgacaaaacctttgctgcttcaaaaggaaatagaggtgttcaagctttctctaagggctctgtgcaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctattggtgagggggactctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcttgtatgttgcattatcaattgggctctttttcctcctcatatatcttggaagaacaggcctctctaaaatgtggcttgctgctactaagaaggcctcatag

SEQ ID NO: 4542 - RNA, 3204 nt, synthetic construct
  misc_feature 1..3204: note = derived and/or modified CDS sequence (wt) from RVFV(Lunyo)__KU167026.1__Gn-Gc
  source 1..3204: mol_type = other RNA
atggcagggattgcaatgacagtccttccagccttagcagtttttgctttggcacctgttgtttttgctgaagaccctcatctcagaaatagaccagggaaggggcacaactacattgacgggatgactcaggaggatgccacatgtaaacctgtgacatatgctggggcatgtagcagttttgatgtcttgcttgaaaagggaaaatttcccctcttccagtcgtatgctcatcatagaactctactggaggcagttcatgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaagactgcaacttttgtaggcagatgacaggtgctagcttgaagaaggggtcttatcccctccaggacctattttgtcagtcaagtgaggatgatggatcaaaattaaaaacaaaaatgaaaggggtctgcgaagttggggttcaagcactcaaaaagtgtgatggccaactcagcactgcacatgaggttgtgccctttgcagtgtttaagaactcaaagaaggtttatcttgataagcttgacctcaagactgaggaaaatctgctaccagactcatttgtctgcttcgagcacaagggacagtataaaggaacaatggtctctggtcagactaagagggagctcaaaagctttgatatctctcagtgtcccaagattggaggacatggtagcaagaagtgcactggggacgcagcattttgctctgcttatgagtgcactgctcaatatgccaatgcctattgctcacatgctaatggatcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccggtcaacagggttcaagatatcatctgcagttgcttgtgctagcggagtttgcgtcacaggatcgcagagtccttctaccgagattacactcaagtatccagggatatcccagtcctctgggggggacataggggttcacatggcacatgatgatcagtcagttagttccaaaatagtagctcactgccctccccaggacccgtgcctagtgcatggctgcatagtgtgtgctcatggcctgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcagatgggtgtataagaagatggttgccagagtggcagacaatatcaatcaagtgaacagggaaataggatggatggaaggaggtcagttggctctagggaaccctgcccctattcctcgtcatgctccaattccacgttatagcacatacctaatgctactattgattgtctcatatgcatcagcatgttcagaactgattcaggcaagctccagaatcaccacttgctccacagaaggtgtcaacaccaggtgtaggctgtctggcacagcattaatcagggcagggtcagttggggcagaggcttgtttgatgttaaagggggtcaaggaagaccaaaccaagttcttgaagataaaaactgtctcaagtgagctatcgtgcagggagggccagagctattggactggatcctttagccccaaatgtctgagctcaaggagatgccatcttgtcggggaatgtcatgtgaataggtgtctgtcttggagggacaatgaaacttcagcagaattttcatttgttggggaaagcacgactatgcgagagaataaatgttttgagcagtgtggaggatggggatgtgggtgtttcaatgtgaacccatcttgcttatttgtgcacacgtatctgcagtcagttagaaaagaggcccttagagttttcaactgtatcgattgggtgcataaactcactctagagattacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaaccttatttcatacaagcccatgatagatcagttggagtgcacaacaaatttgattgatccctttgttgtctttgagaggggttctctaccacagacaaggaatgacaaaacctttgcagcttcaaaaggaaataggggtgttcaagctttctctaagggctctgtacaagctgacctaactctgatgtttgacaattttgaggtggactttgtgggggcagccgtgtcttgtgatgccgccttcttaaatttgacaggttgctattcctgcaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaggggaccctgatagctattgatccatttgatgataggcgagaagcagggggggaatcaacagttgtgaatccaaaatctggatcttggaatttctttgactggttttctggactcatgagttggtttggagggccccttaagactatactccttatttgcctgtatgtagcattatcaattgggctctttttccttcttatatatcttggaagaacaggtctctctaaaatgtggcttgctgccactaagaaagcctcatag

SEQ ID NO: 4543 - RNA, 3204 nt, synthetic construct
  misc_feature 1..3204: note = derived and/or modified CDS sequence (wt) from RVFV(200803167)__JF311382.1__Gn-Gc
  source 1..3204: mol_type = other RNA
atggcagggattgcgatgacagtccttccagccttagcagtttttgctttggcacctgttgtttttgctgaagacctccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattgcactcaagtatccagggatatcccagtcctctgggggggatataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagggaaataggatggatggaagggggtcagttggttctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgtttcgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatgctcctcatttgcctgtatgttgcattatcaattgggctcttcttcctccttatatatcttggaagaacaggcctctctaaaatgtggcttgccgctactaagaaggcctcatag

SEQ ID NO: 4544 - RNA, 3204 nt, synthetic construct
  misc_feature 1..3204: note = derived and/or modified CDS sequence (wt) from RVFV(2373/74)__DQ380194.1__Gn-Gc
  source 1..3204: mol_type = other RNA
atggcagggattgcaatgacagtccttccagccttagcagtttttgctttggcacctgttgtttttgctgaagaccctcatctcagaaacagaccagggaaggggcacaactacattgacgggatgactcaggaggatgccacatgtaaacctgtgacatatgctggggcatgtagcagttttgatgtcttgctcgaaaagggaaaattccccctcttccagtcatatgctcatcatagaactctactagaggcagttcacgacaccatcattgcaaaggctgacccacctagctgtgacctccagagtgctcatgggaatccctgcatgaaagagaaactcgtgatgaagacacactgcccaaatgactaccagtcagctcattacctcaacaatgacgggaaaatggcttcagtcaagtgccctcctaagtatgagctcactgaggactgcaacttttgtaggcagatgacaggtgctagcttgaagaaggggtcttatcctctccaggacttgttctgtcaatcaagtgaggatgatggatcaaaattaaaaacaaaaatgaaaggggtctgcgaagtgggggttcaagcactcaaaaagtgtgatggccaactcagcactgcacatgaggttgtgccatttgcagtgtttaaaaactcaaagaaggtttatcttgacaagcttgacctcaagactgaggaaaatctgctaccagactcatttgtctgcttcgagcataagggacagtataaagggacaatggactctggtcagactaagagggagctcaaaagttttgatatctctcagtgccccaagattggaggacatggtagcaagaagtgcactggggacgcagcattttgctctgcttatgagtgcactgctcaatacgccaatgcctattgttcacatgctaatgggtcaggaattgtacagatacaagtatccggggtctggaagaagcctttatgtgtaggatatgagagagtggttgtgaagagagaactctctgctaagcccatccagagagttgagccttgcacaacttgtataaccaaatgcgagcctcatgggttggttgtccgatcaacagggttcaagatatcttctgcagttgcttgtgctagcggagtttgcgtcacaggatcacagagcccttctaccgagattacactcaagtatccaggaatatcccagtcctctgggggggacataggggttcacatggcacatgatgatcagtcagttagctccaaaatggtagctcactgccccccccaggacccgtgcctagtgcatggctgcatagtgtgtgctcatggcttgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcaggtgggtgtataagaagatggttgccagagtggcagacaatatcaatcaagtgaacagggaaataggatggatggaaggaggccagttggctctagggaaccctgcccctattcctcgtcatgccccaattccacgttatagcacatacctaatgctactattgattgtctcatatgcatcagcatgttcagaactgattcaggcaagctccagaatcaccacctgctccacagaaggtgtcaacaccaagtgtaggctgtctggcacagcattaatcagggcagggtcagttggggcagaggcttgtttgatgttaaagggggtcaaagaagaccaaaccaagttcttgaagataaaaactgtctcaagtgagctatcgtgcagggaaggccagagctattggactgggtcctttagccccaaatgcctgagctcaaggaggtgccatcttgtcggggaatgtcatgtgaataggtgtctgtcttggagggacaatgaaacttctgcagaattttcatttgttggggaaagcacgaccatgcgagagaataagtgttttgagcagtgtggaggatggggatgtgggtgtttcaatgtgaatccatcttgcttatttgtgcacacgtatctgcagtcggttagaaaagaggcccttagagttttcaactgtattgattgggtgcataaactcactctagagatcacagactttgatggctctgtttcaacattagacttgggagcatcatctagccgtttcacaaactggggttcggttagcctctcactggatgcagagggcatttcaggctcaaatagcttttctttcattgagagcccaggcaaagggtatgcaattgttgatgagccattctcagaaattcctcggcaagggttcttgggagagatcaggtgcaattcagaatcttcagtcctgagtgctcatgaatcatgccttagggcaccaaaccttatctcatacaagcctatgatagatcagttggagtgcacaacaaatctgattgatccctttgttgtctttgagaggggttctctgccacagacaaggaatgaaaaaacctttgcagcttcaaaaggaaataggggtgttcaagctttctccaagggctctgtacaagctgatcttactctgatgtttgacaattttgaggtggactttgtgggagcagccgtgtcttgtgatgccgccttcttaaatttaacaggttgctattcctgcaatgcaggagccagagtctgcttgtctatcacatccacaggaactggaactctctctgcccacaataaggatgggtctctgcacatagttcttccatcagagaatggaacaaaagatcagtgtcagatactacacttcactgtacctgaggtggaggaggagtttatgtactcttgtgatggagatgagcggcctctattggtgaaggggaccctgatagctattgatccatttgatgataggcgagaagcaggaggggaatcaacagttgtgaatccaaaatctggttcttggaatttctttgactggttttctggacttatgagttggtttggagggcctcttaagaccatactcctaatttgcctgtatgtggcattatcaattgggctctttttcctccttatatatcttggaagaacaggtctctctaaaatgtggcttgctgccactaagaaagcctcatag

SEQ ID NO: 4545 - RNA, 3204 nt, synthetic construct
  misc_feature 1..3204: note = derived and/or modified CDS sequence (wt) from RVFV(Kenya 57 (Rintoul))__DQ380192.1__Gn-Gc
  source 1..3204: mol_type = other RNA
atggcagggattgcaatgacagtccttccagccttagcagtttttgctttggcacctgttgtttttgctgaagaccctcatctcagaaacagaccagggaagggacacaactacattgacgggatgactcaggaggatgccacatgtaaacctgtgacatatgctggggcatgtagcagttttgatgtcttgctcgaaaagggaaaatttcccctcttccagtcgtatgctcatcatagaactctattagaggcagttcacgacaccatcattgcaaaggctgatccacctagctgtgaccttcagagtgctcatgggaatccctgcatgaaagagaaactcgtaatgaagacacactgtccaaatgactaccagtcagctcattacctcaacaatgacgggaaaatggcttcagtcaagtgccctcctaagtatgagctcactgaggactgcaacttttgtaggcagatgacaggtgctagcttgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgacaagcttgacctcaagactgaggaaaatctgctaccagactcatttgtctgcttcgagcataagggacagtacaaaggaacaatggactctggtcagattaagagggagctcaaaagctttgatatctctcagtgccccaagattggaggacatggtagcaagaagtgcactggggacgcagcattttgctctgcttatgagtgtactgctcaatacgccaatgcctattgttcacatgctaatgggtcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctactgagattacactcaagtatccagggatatcccagtcctctgggggagacataggggttcacatggcacatgatgatcagtcagttagctccaaaatagtagctcactgccccccccaggacccgtgcctagtgcatggctgcatagtgtgtgctcatggcttgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcagatgggtgtataagaagatggttgccagagtggcagacaatatcaatcaagtgaacagggaaataggatggatggaaggaggccagttggttctagggaaccctgcccctattcctcgtcatgctccaattccacgttatagcacatacctaatgctgctattgattgtctcatatgcatcagcatgttcagaactaattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccagaccaagttcttgaagataaaaactgtctcaagtgagctatcgtgtagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtattgattgggtgcataaactcactctagagatcacagactttgatggctctgtttcaacagtagacttgggagcatcatctagccgtttcacaaactggggttcagttagcctctcactggacgcagagggcatttcaggctcaaatagcttctctttcattgagagcccaggcaaagggtatgcaattgttgatgagccattctcagaaatttctcggcaagggttcttgggagagatcaggtgcaattcagaatcttcagtcctgagtgctcatgaatcatgccttagggcaccaaaccttatctcatacaaacccatgatagatcagttggagtgcacaacaaatctgattgatccctttgttgtctttgagaggggttctctgcctcagacaaggaatgacaaaacctttgcagcttcaaaaggaaataggggtgttcaagctttctctaagggctctgtacaagctgatctaactctgatgtttgacaattttgaggtggactttgtgggagcagccgtgtcttgtgatgccgccttcttaaacttgacaggttgctattcctgcaatgcaggggccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaggggaccctgatagctattgatccatttgatgataggcgagaagcagggggggaatcaacagttgtgaatccaaaatctggatcttggaatttctttgactggttttctggacttatgagttggtttggagggcctcttaagactatactcctaatttgcctgtatgtagcattatcaattgggctctttttccttcttatatatcttggaagaacaggtctctccaaaatgtggcttgctgccactaagaaagcttcatag

SEQ ID NO: 4546 - RNA, 3204 nt, synthetic construct
  misc_feature 1..3204: note = derived and/or modified CDS sequence (wt) from RVFV(RVFBJ01/2016)__KX785331.1__Gn-Gc
  source 1..3204: mol_type = other RNA
atggcagggattgcaatgacagttcttcccgccttagcagtttttgctttggcacctgttgtttttgctgaggaccctcatctcagaaacagaccagggaagggacataactacattgacgggatgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgatccacctagctgtgatctccagagtgctcatgggaatccctgcatgaaagagaaactcgtgatgaagacacactgtccaaatgactaccagtcagctcattacctcaacaatgacgggaaaatggcttcagtcaagtgccctcctaagcatgagcttactgaggactgcaacttttgtaggcagatgacaggtgctagcttgaagaaggggtcttatcctctccaggacttattttgtcagtcaagtgaggatgatggatcaaaactaaagacaaaaatgaaaggggtctgcgaagtgggggttcaggcactcaaaaagtgtgatggccaactcagcactgcacatgaggttgtgccctttgcagtgtttaagaattcaaagaaggtttatcttgacaagcttgaccttaagactgaagaaaatctgctaccagactcatttgtctgctttgagcataagggacagtataaaggaacaatggactctggtcagactaagagggagctcaaaagctttgatatctctcagtgccccaagattgggggacatggtagcaagaagtgcactggggacgcagcattttgctctgcttatgagtgtactgctcaatatgccaatgcctattgttcacatgctaatgggtctgggattgtacagatacaagtatccggggtctggaagaagcctttatgtgtggggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgccagcggagtttgcgtcacaggatcgcagagcccttctactgagatcactctcaagtatccagggatatcccagtcctctgggggggatataggggttcacatggcacatgatgatcagtcagttagctccaaaatagtggctcactgccccccccaggacccgtgcctagtgcatggctgcatagtgtgtgctcatggcttgataaattaccagtgtcacactgctcttagtgcttttgttgttgtgttcgtattcagctctgttgcaataatttgtctggccattctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgcacccattcctcgtcatgctccgattccacgttatagcacatacctaatgctactattgattatctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttaatgttaaagggggtcaaggaagaccagaccaagttcttgaagataaaaactgtctcaagtgagctatcgtgcagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtggatgtttcaatgtgaacccatcttgcttatttgtgcacacgtatctgcaatcagttagaaaagaggctcttagagtttttaactgtattgattgggtgcataaactcactctagagatcacagactttgatggctctgtttcaacaatagacttgggagcatcatctagccgtttcacaaactggggctcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttctgtcctgagtgctcatgagtcatgccttagggcaccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaaaggctctgtacaggctgatctaactctgatgtttgacaattttgaggtggactttgtgggagcagccgtgtcttgtgatgccgccttcttaaatttgacaggttgctattcctgcaatgctggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagttcatgtactcttgtgatggagatgagcgacctttgttggtgaaggggaccctaatagctattgatccatttgatgataggcgagaagcagggggagaatcaacagttgtgaatccaaaatctggatcttggaacttctttgactggttttctggacttatgagttggtttggaggacctcttaagactatactcctaatttgcctgtatgtagcattatcaattgggctctttttccttcttatatatcttggaagaacaggtctctctaaaatgtggcttgctgccactaagaaagcctcatag

SEQ ID NO: 4547 - RNA, 3204 nt, synthetic construct
  misc_feature 1..3204: note = derived and/or modified CDS sequence (wt) from RVFV(clone 13)__DQ380213.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcccctcttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagcatgagctcacagaggactgcaacttttgtaggcagatgacaggtgctagcctgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcacaagggacagtataagggaacaatggactctggtcagactaagagggagctcaaaagctttgatatttctcagtgccccaagattggaggacatggtagtaagaagtgcactggggacgcagcattttgctctgcttatgagtgcactgctcagtatgccaatgcttattgttcacatgctaatgggtcagggattgtgcagatacaagtatcaggggtctggaagaagcctttatgtgtagggtatgagagagtggttgtgaagagagaactctctgccaagcccatccagagggttgagccttgcacaacttgtataaccaaatgtgagcctcatggattggttgtccgatcaacagggttcaagatatcatctgcagttgcttgtgctagcggagtttgcgtcacaggatcgcagaatccttccaccgagatcacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgttcgtgttcagttctattgcaataatttgtttagctattctttatagggtgctcaagtgcctaaagattgccccaaggaaagttctgaatccactaatgtggattacagccttcatcagatgggtgtataagaagatggttgccagagtggcagacaatattaatcaagtgaatagggaaataggatggatggaaggaggtcagttggtcctagggaaccctgcccctattcctcgccatgccccaattccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtctgatgttgaagggggtcaaggacgatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactaacactagagatcacagactttgatggctctgtttcaacaatagacctaggagcatcatctagccgtttcacaaactggggttcagtcagcctctcactggacgcagagggcatttcaggctcaaatagcttttctttcattgagagcccaggcaaagggtatgcaattgttgatgagccattctcagaaattcctcggcaagggttcctgggggagatcaggtgcaattcagagtcctcagtcctgagtgctcatgaatcatgccttagggcaccaaaccttatctcatacaagcccatgatagaccaattggagtgcacaacgaatctgattgatccatttgttgtctttgagaggggttctctgccacagacaaggaatgaaaaaacctttgcagcttcaaaaggaaatagaggtgtccaagccttctctaagggctctgtacaagctgatctaactctgatgtttgacaattttgaggtggattttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcaatgccagatactacacttcactgtacctgaggtagaggaggagtttatgtactcttgtgacggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactccttatttgcctgtatgttgcattatcaattgggctctttttcctcctcatatatcttggaagaacaggcctctctaaaatgtggcttgctgctactaagaaggcctcatag

SEQ ID NO: 4548 - RNA, 3204 nt, synthetic construct
  misc_feature 1..3204: note = derived and/or modified CDS sequence (wt) from RVFV__JQ068143.1__Gn-Gc
  source 1..3204: mol_type = other RNA
atggcagggattgcaatgacagtccttcccgccttagcagtttttgctttggcacctgttgtttttgctgaggaccctcatctcagaaacagaccagggaagggacacaactacattgacgggatgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgacccacctagctgtgatcttcagagtgctcatgggaacccctgcatgaaagagaaactcgtgatgaagacacactgtccaaatgactaccagtcagctcattatctcaacaatgacgggaaaatggcttcagtcaagtgccctcctaagtatgagctcactgaggactgcaacttttgtaggcagatgacaggtgctagcttgaagaaggggtcttatcctctccaggacttattttgtcagtcaagtgaggatgatgggtcaaaattaaagacaaaaatgaaaggggtctgcgaagtgggggttcaagcactcaaaaagtgtgatggccaactcagcactgcacatgaggttgtgccctttgcagtgtttaagaactcaaagaaggtttatcttgacaagcttgacctcaagactgaagaaaatctgctaccagactcatttgtctgctttgagcataaaggacagtataaaggaacaatagactctggtcagactaagagagagctcaaaagctttgatatctctcagtgccccaagattggaggacatggtagcaagaagtgcactggggacgcagcattttgctctgcttatgagtgtactgctcagtatgccaatgcctattgttcacatgctaatgggtctgggattgtacagatacaagtgtccggggtctggaagaagcctctgtgtgtaggatatgagagagtggttgtgaagagagaactctctgccaagcccatccagagagttgagccttgcacaacttgcataaccaaatgtgagcctcatggattggttgtccgatcaacagggtttaagatatcatctgcagttgcttgtgctagcggggtttgcgtcacaggatcgcagagcccttctactgagatcactcttaagtatccagggatatcccaatcctctgggggggacataggagttcacatggcacatgatgatcagtcagttagctccaaaatagtggctcactgccccccccaggacccgtgcctagtgcatggctgcatagtgtgtgctcatggcttgataaattaccagtgtcacactgctctcagtgcttttgttgttgtattcgtattcagctctgttgcaataatttgtctggccatcctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgctcctattcctcgtcatgctccaattccacgttatagcacgtatctaatgctactattgattatctcatatgcatcagcatgttcagaactgattcaggcaagctccagaatcactacttgctccacagaaggtgtcaacaccaagtgtaggctgtctggcacagcattaatcagggcagggtcagttggggcagaggcttgtttaatgttaaagggggtcaaggaagaccagaccaagttcttgaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacctcagcagaattttcatttgttggggaaagcacgaccatgcgagagaataagtgttttgagcagtgtggaggatggggatgtggatgtttcaatgtgaacccatcttgcttatttgtgcacacgtatctgcagtcagttagaaaagaggcccttagagtttttaactgtattgattgggtgcataaactcactctagagatcacagactttgatggctctgtttcaacaatagacttgggggcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggagagatcaggtgcaattcagaatcttctgtcctgagtgctcatgaatcatgccttagggctccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaagggctctgtacaagctgatctaactctgatgtttgacaattttgaggtggactttgtgggggcagccgtgtcttgtgatgccgccttcttaaatttgacaggttgctattcctgcaatgctggagccagagtctgcctgtctatcacatccacaggaactggaactctttctgcccacaataaggatgggtctctgcacatagttcttccatcagagaatggaacaaaagatcagtgtcagatactacacttcactgtacctgaggtggaggaggagtttatgtactcttgtgatggagatgagcggcctttgttggtgaaggggaccctaatagctattgatccatttgatgataggcgagaagcagggggagaatcaacagttgtgaatccaaaatctggatcttggaacttctttgactggttttctggacttatgagttggtttggagggcctcttaagactatactcctaatttgcctgtatgtagcattatcaattgggctctttttccttcttatatatctcggaagaacaggtctctctaaaatgtggcttgctgccactaagaaagcctcatag

SEQ ID NO: 4549 - RNA, 3204 nt, synthetic construct
  misc_feature 1..3204: note = derived and/or modified CDS sequence (wt) from RVFV(SA-75)__DQ380189.1__Gn-Gc
  source 1..3204: mol_type = other RNA
atggcaaggattgcaatgacagtccttccagccttagcagtttttgctttggcacctgttgtttttgctgaagaccctcatctcagaaacagaccagggaaggggcacaactacattgacgggatgactcaggaggacgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccctgcatgaaggagaaactcgtgatgaagacacactgtccaaatgactaccagtcagctcattacctcaacaatgacgggaaaatggcttcagtcaagtgccctcctaaatatgagctcactgaggactgcaatttttgcaggcagatgacaggtgctagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctcaaaagctttgatatctctcagtgccccaagattggaggacatggtagcaagaagtgcactggggacgcagctttttgctctgcttatgagtgcactgctcaatacgccaatgcttattgttcacatgctaatgggtcaggagttgtacagatacaagtatccggggtctggaagaagcctttgtgtgtcgggtatgagagggtggttgtgaagagagaactctctgctaagcccatccagagagttgagccttgcacaacttgtataaccaaatgtgagcctcacggattggttgtccgatcaacaggtttcaagatatcatctgcagttgcttgtgctagcggagtttgcgttacaggatcgcagagcccttctaccgagattacactcaagtatccagggatatcccagtcctctgggggggacataggggttcacatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctgaatccactaatgtggattactgttttcatcagatgggtgtataagaagatggttgccagagtagcagacaatatcaatcaggtgaacagggaaataggatggatggaaggaggccagctggctctagggaaccctgcccctattcctcgtcatgctccaattccacgttatagcacatacctaatgctactattgattgtctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagagacaatgaaacctcagcagaattttcatttgttggggaaagcacgaccatgcgggagaacaagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgatggctctgtttcaacaatagacctgggagcatcatctagccgtttcacaaactggggttcagttagcctctcactggacgcagagggcatttcaggctcaaacagcttttccttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaatcttatttcatacaagcccatgatagatcagttggagtgcacaacaaatctgattgacccctttgttgtctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatggatctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttccttcttatatatcttggaagaacaggcctctctaaaatgtggcttgctgccaccaagaaagcctcatag

SEQ ID NO: 4550 - RNA, 3204 nt, synthetic construct
  misc_feature 1..3204: note = derived and/or modified CDS sequence (wt) from RVFV(ANK-6087)__DQ380216.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgagaaggggaaattcccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttaccttgataagcttgacctcaagactgaggagaatctgctaccagactcatttgtctgcttcgagcataagggacagtataaaggaaaattggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtagttgtgaagagagaactctctgccaagcccatccagagagttgagccttgcacaacttgtataaccaaatgtgagcctcatgggttggttgtccgatcaacagggttcaagatatcatctgcagttgcttgtgctagcggagtttgcgtcacaggatcgcagagtccttccaccgagattacactcaagtatccagggatatcccagtcctctggaggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgccccaaggaaagttctgaatccactaatgtggattacagccttcatcagatgggtgtataggaagatggttgccagagtggcagacaatattaatcaagtgaacagggagataggatggatggaaggaggtcagttggttctagggaaccctgcccctattcctcgtcatgttccaattccacgttatagcacatacctaatgctactactgattgtctcatatgcatcagcatgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaaaataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggagaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctggagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgagtcatgccttagggcaccaaaccttatctcatacaagcccatgatagatcaattggagtgctcaacaaatctgattgacccctttgttgtatttaagaggggttctctgccacagacaaggaatgacaaaacctttgctgcttcaaaaggaaatagaggtgttcaagctttctctaagggctctgtgcaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctattggtgagggggactctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcttgtatgttgcattatcaattgggctctttttcctcctcatatatcttggaagaacaggcctctctaaaatgtggcttgctgctactaagaaggcctcatag

SEQ ID NO: 4551 - RNA, 3204 nt, synthetic construct
  misc_feature 1..3204: note = derived and/or modified CDS sequence (wt) from RVFV(KEN/Kil-006/07)__HM586966.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctgatggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgccactaagaaggcctcatag

SEQ ID NO: 4552 - RNA, 3204 nt, synthetic construct
  misc_feature 1..3204: note = derived and/or modified CDS sequence (wt) from RVFV(MgH824)__DQ380210.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggtacaactacattgacgggatgactcaggaggatgccacatgcaaacctgtgacatatgctggggcatgtagcagttttgatgtcttgcttgaaaaggggaaatttccccttttccagtcgtatgctcatcatagaactctactagaggcagttcacgacaccatcattgcaaaggctgacccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcgtaagggacagtacaaaggaacaatggactctggtcagactaagagggagctcaaaagctttgatatctctcagtgccccaagattggaggacatggtagtaagaagtgcactggggacgcagcattttgctctgcttatgagtgcactactcagtacgccaatgcctattgttcacatgctaatgggtcaggggttgtgcagatacaagtgtcaggggtctggaagaagcctttatgtgtaggatatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaatattaatcaagtgaacagggaaataggatggatggaaggaggtcagttggttctagggaaccctgcccctattcctcgtcatgccccaatcccacgttatagcacatacctgatgttactattgattgtctcatatgcatcagcatgttcagaactgattcaggcaagctccagaatcaccacttgctctacagagggtgttgacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacaaccatgcgagagaataagtgttttgagcagtgtggaggatgggggtgtgggtgtttcaatgtgaacccatcttgcttatttgtgcacacgtatctgcagtcagttagaaaagaggcccttagagtttttaactgtatcgactgggtacataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattcccagagattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgacccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacatttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaaggacaggcctctctaaaatgtggcttgctgccactaagaaggcctcatag

SEQ ID NO: 4553 - RNA, 3204 nt, synthetic construct
  misc_feature 1..3204: note = derived and/or modified CDS sequence (wt) from RVFV(KEN/Mal-032/07)__HM586967.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggagacttcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctgatggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4554 - RNA, 3204 nt, synthetic construct
  misc_feature 1..3204: note = derived and/or modified CDS sequence (wt) from RVFV(Kenya 56 (IB8))__DQ380190.1__Gn-Gc
  source 1..3204: mol_type = other RNA
atggcagggattgcaatgacagtccttccagccttagcagtttttgctttggcacctgttgtttttgctgaagaccctcatctcagaaacagaccagggaaggggcacaactacattgacgggatgactcagggggatgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccttgcatgaaggagaaactcgtgatgaagacacactgtccaaaagactaccagtcagctcattacctcaacaatgacgggaaaatggcttcagtcaagtgccctcctaaatatgagctcactgaggactgcaatttttgcaggcagatgacaggtgccagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctaaaaagctttgatatctctcagtgccccaagattggaggacatggtagcaagaagtgcactggggacgcagctttttgctctgcttatgagtgcactgctcaatacgccaatgcttattgttcacatgctaatgggtcaggaattgtacagatacaagtatccggggtctggaagaggcctttgtgtgtagggtatgagagggtggttgtgaagagagaactctctgctaagcccatccagagagttgagccttgcacaacttgtataaccaaatgtgagcctcatggattggttgtccgatcaacaggtttcaagatatcatctgcagttgcttgtgctagcggagtttgcgttacaggatcgcagagcccttctaccgagattacactcaagtatccagggatgtcccagtcctctgggggggacataggggttcatatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctgaatccactaatgtggattactgctttcatcagatgggtgtataagaagatggttgccagagtggcagacaatatcaatcaggtgaacagggaaataggatggatggaaggaggccagccggctctagggaaccctgcccctattcctcgtcatgctccaattccacgttatagcacatacctaatgctactattgattgtctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagagagggccagagctattggactgggtcctttagccctaaatgtctgagctcaaggaggtgccatcttgtcggggaatgtcatgtgaataggtgtctgtcttggagagacaatgaaacttcagcagaattttcatttgttggggaaagcacgaccatgcgggagaataagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgatggctctgtttcaacaatagacctgggagcatcatctagccgtttcacaaactggggttcagttagcctctcactggacgcagagggcatttcaggctcaaacagcttttctttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaaccttatttcatacaagcccatgatagatcagttggagtgcacaacaaatctgattgatccctttgttgcctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatgggtctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttcctccttatatatcttggaagaacaggcctctctaaaatgtggcttgctgccaccaagaaagcctcatag

SEQ ID NO: 4555 - RNA, 3204 nt, synthetic construct
  misc_feature 1..3204: note = derived and/or modified CDS sequence (wt) from RVFV(KEN/Gar-008/06)__HM586965.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaagggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataatttgaaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtaaaagaggagttcatgtactcttgtgatggagatgagcgggctctgttaatgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4556 - RNA, 3204 nt, synthetic construct
  misc_feature 1..3204: note = derived and/or modified CDS sequence (wt) from RVFV(KEN/Bar-035/07)__HM586969.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggagacttcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctgacggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcacggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4557 - RNA, 3204 nt, synthetic construct
  misc_feature 1..3204: note = derived and/or modified CDS sequence (wt) from RVFV(Smithburn)__DQ380193.1__Gn-Gc
  source 1..3204: mol_type = other RNA
atggcagggattgcaatgacagtctttccagccttagtagtttttgctttggcacctgttgtttttgctgaagaccctcatctcagaaacagaccagggaagggacacaactacattgacgggatgactcaggaggatgccacatgtaaacctgtgacatatgctggggcatgtagcagttttgatgtcttgctcgaaaagggaaaatttcccctcttccagtcgtatgctcatcatagaactctattagaggcagttcacgacatcatcattgcaaaggctgatccacctagctgtaaccttcagagtgctcatgggaatccctgcatgaaagagaaactcgtaatgaagacatactgtccaaatgactaccagtcagctcattacctcaacaatgacgggaaaatggcttcagtcaagtgccctcctaagcatgagctcactgaggactgcaacttttgtaggcagatgacaggtgctagcttgaaggaggggtcttatcctctccaagacttattttgtcagtcaagtgaggatgatggatcaaaattaaaaacaaaaatgaaaggggtctgcgaagtgggggttcaagtactcaaaaagtgtgatggccaactcagcactgcacatgaagttgtgccctttgcagtgtttaagaactcaaagaaggtttatcttgacaagcttgacctcaagactgaggaaaatctgctaccagactcatttgtctgcttcgagcataagggacagtacaaaggaacaatggactctggtcagattaagagggagctcaaaagctttgatatctctcagtgccccaagattggaggacatggtagcaagaagtgcactggggacgcagcattttgctctgcttatgagtgtactgctcaatacgccaatgcctattgttcacatgctaatgggtcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctactgagattacactcaagtatccagggatatcccagtcctctgggggagacataggggttcacatggcacatgatgatcagtcagttagctccaaaatagtggcccactgccccccccaggacccgtgcctagtgcatggctgcatagtgtgtgctcatggcttgataaattaccagtgtcacactgctttcagtgcctttgttgttgtgttcgtattcagctctgttgtgataatttgtttggccattctttataaggtgctcaagtgcctaaagattgccccaaggaaagttctgaatccactaatgtggatcactgccttcatcagatgggtgtataagaagatggttgccagagtggcagacaatattaatcaagtaaacagggaaataggatggatggaaggaggccagttggttctagggaaccctgcccctattcctcgtcatgctccaattccacgttatagcacatacctaatgctgctattgattgtctcatatgcatcagcatgttcagaactaattcaggcaagctccagaatcaccacttgctccacagaaggtgtcaacaccaagtgcaggctgtctggcacagcattaatcagggcagggtcagttggggcagaggcttgtttgatgttaaagggggtcaaggaagaccagaccaagttcttgaagataaaaactgtctcaagtgagctatcatgtagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgaacagtgtggaggatggggatgtgggtgtttcaatgtgaacccatcttgcttatttgtgcacacgtatctgcagtcagttagaaaagaagcccttagagtttttaactgtattgattgggtgcataaactgactctagagattacagactttgatggctctgtttcaacagtagacttgggagcatcatctagccgtttcacaaactggggttcagtcagcctctcactggacgcagagggcatttcaggctcaaatagcttctctttcattgagagcccaggcaaagggtatgcaattgttgatgagccattctcagaaattcctcggcaagggttcttgggagagatcaggtgcaattcagaatcttcagtcctgagtgctcatgaatcatgccttagggcaccaaaccttatctcatacaaacccatgatagatcagttggagtgcacaacaaatctgattgatccctttgttgtctttgagaggggttctctgcctcagacaaggaatgacaaaacctttgcagcttcaaaaggaaataggggtgttcaagctttctctaagggctctgtacaagctgatctaactctgatgtttgacaattttgaggtggactttgtgggagcagccgtgtcttgtgatgccgccttcttaaacttgacaggttgctattcctgcaatgcaggggccagagtctgcctgtctatcacatccacaggaactggaactctttctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatagctattgatccatttgatgataggcgagaagcagggggggaatcaacagttgtgaatccaaaatctggatcttggaatttctttgactggttttctggacttatgagttggtttggagggcctcttaagactatactcctaatttgcctgtatgtagcattatcaattgggctttttttctttcttatatatcttggaagaacaggtctctctaaaatgtggcttgctgccactaagaaagcttcatag

SEQ ID NO: 4558 - RNA, 3204 nt, synthetic construct
  misc_feature 1..3204: note = derived and/or modified CDS sequence (wt) from RVFV(Beijing-01)__KX611606.1__Gn-Gc
  source 1..3204: mol_type = other RNA
atggcagggattgcaatgacagttcttcccgccttagcagtttttgctttggcacctgttgtttttgctgaggaccctcatctcagaaacagaccagggaagggacataactacattgacggggtgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgatccacctagctgtgatctccagagtgctcatgggaatccctgcatgaaagagaaactcgtgatgaagacacactgtccaaatgactaccagtcagctcattacctcaacaatgacgggaaaatggcttcagtcaagtgccctcctaagtatgagcttactgaggactgcaacttttgtaggcagatgacaggtgctagcttgaagaaggggtcttatcctctccaggacttattttgtcagtcaagtgaggatgatggatcaaaactaaagacaaaaatgaaaggggtctgcgaagtgggggttcaagcactcaaaaagtgtgatggccgactcagcactgcacatgaggttgtgccctttgcagtgtttaagaattcaaagaaggtttatcttgacaagcttgaccttaagactgaagaaaatctgctaccagactcatttgtctgctttgagcataagggacagtataaaggaacaatggactctggtcagactaagagggagctcaaaagctttgatatctctcagtgccccaagattgggggacatggtagcaagaagtgcactggggacgcagcattttgctctgcttatgagtgtactgctcaatatgccaatgcctattgttcacatgctaatgggtctgggattgtacagatacaagtatccggggtctggaagaagcctttatgtgtggggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgccagcggagtttgcgtcacaggatcgcagagcccttctactgagatcactctcaagtatccagggatatcccagtcctctgggggggatataggggttcacatggcacatgatgatcagtcagttagctccaaaatagtctttgactgccctccccaggacccgtgcctagtgcatggctgcatagtgtgtgctcatggcttgataaattaccagtgtcacactgctcttagtgcttttgttgttgtgttcgtattcagctctgttgcaataatttgtctggccattctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgctcccattcctcgtcatgctccgattccacgttatagcacatacctaatgctactattgattatctcatatgcatcagcatgttcagaactgattcaggcaagctccagaatcaccacttgctccacagaaggtgtcaacaccaagtgtaggctgtctggcacagcattaatcagggcagggtcagttggggcagaggcttgtttgatgtttgagggggtcaaggaagaccagaccaagttcttaaagataaaaactgtctcaagtgagctatcgtgcagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtggatgtttcaatgtgaacccatcttgcttatttgtgcacacgtatctgcaatcagttagaaaagaggctcttagagtttttaactgtattgattgggtgcataaactcactctagagatcacagactttgatggctctgtttcaacaatagacttgggagcatcatctagccgtttcacaaactggggctcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttctgtcctgagtgctcatgagtcatgccttagggcaccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaaaggctctgtacaggctgatctaactctgatgtttgacaattttgaggtggactttgtgggagcagccgtgtcttgtgatgccgccttcttaaatttgacaggttgctattcctgcaatgctggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagttcatgtactcttgtgatggagatgagcgacctttgttggtgaaggggaccctaatagctattgatccatttgatgataggcgagaagcagggggagaatcaacagttgtgaatccaaaatctggatcttggaacttctttgactggttttctggacttatgagttggtttggaggacctcttaagactatactcctaatttgcctgtatgtagcattatcaattgggctctttttccttcttatatatcttggaagaacaggtctctctaaaatgtggcttgctgccactaagaaagcctcatag

SEQ ID NO: 4559 - RNA, 3204 nt, synthetic construct
  misc_feature 1..3204: note = derived and/or modified CDS sequence (wt) from RVFV(KEN/Bar-032/07)__HM586968.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggagacttcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgacccacctagctgtgaccttcagagtgctgatggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaaatgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgtgggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctcacacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgaggtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4560 - RNA, 3204 nt, synthetic construct
  misc_feature 1..3204: note = derived and/or modified CDS sequence (wt) from RVFV(TAN/Dod-002/07)__HM586971.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggtccaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtaggaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcaggcctggataatctctcagtggcacacggctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4561 - RNA, 3204 nt, synthetic construct
  misc_feature 1..3204: note = derived and/or modified CDS sequence (wt) from RVFV(KEN/Gar-004/06)__HM586964.1__Gn-Gc
  source 1..3204: mol_type = other RNA
atggcagggattgcgatgacagtccttccagccttagcagtttttgctttggcacctgttgtttttgctgaagacccccatctcagaaacagaccagggaaggggcacaactacattgacggaatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcacagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtaggaagaagagaactggggacgcagcattttgctctgcttatgaatgcactgctcagtatgccaatgcctattgttcacgtgccaacgggtcagggattgtgcagattcaagtatcaagggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaataaccagtcacactctgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagcatgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagattacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgaggtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctcatag

SEQ ID NO: 4562 - RNA, 1680 nt, synthetic construct
  misc_feature 1..1680: note = derived and/or modified CDS sequence (wt) from RVFV(ZH-548)__DQ380206.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagca

SEQ ID NO: 4563 - RNA, 1680 nt, synthetic construct
  misc_feature 1..1680: note = derived and/or modified CDS sequence (wt) from RVFV(MP-12)__DQ380208.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcatcacctcaacaatgacgggaaaatggcttcagtcaagtgccctcctaagtatgagctcactgaagactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagca

SEQ ID NO: 4564 - RNA, 1680 nt, synthetic construct
  misc_feature 1..1680: note = derived and/or modified CDS sequence (wt) from RVFV(MP12)__Z30318.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcatcacctcaacaatgacgggaaaatggcttcagtcaagtgccctcctaagtatgagctcactgaagactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcacacaacattaatcaagtgaacagggaaataggatggatggaaggaggtcagttggttctagggaaccctgcccctattcctcgtcatgccccaatcccacgttatagcacatacctgatgttattattgattgtctcatatgcatcagca

SEQ ID NO: 4565 - RNA, 1680 nt, synthetic construct
  misc_feature 1..1680: note = derived and/or modified CDS sequence (wt) from RVFV(2007001811)__EU574040.1__Gn
  source 1..1680: mol_type = other RNA
atggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctgctagaggcagttcacgacaccatcattgcaaaggctgatccacctagctgtgacctccagagtgctcatgggaatccctgtatgaaagagaaacttgtgatgaagacacattgtcctaacgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagca

SEQ ID NO: 4566 - RNA, 1680 nt, synthetic construct
  misc_feature 1..1680: note = derived and/or modified CDS sequence (wt) from RVFV(2250/74)__DQ380209.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaagtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtaggatatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaatattaatcaagtgaacagggaaataggatggatggaaggaggtcagttggttctagggaaccctgcccctattcctcgtcatgccccaatcccacgttatagcacatacctgatgttactattgattgtctcatatgcatcagca

SEQ ID NO: 4567 - RNA, 1680 nt, synthetic construct
  misc_feature 1..1680: note = derived and/or modified CDS sequence (wt) from RVFV(T1)__DQ380201.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagca

SEQ ID NO: 4568 - RNA, 1680 nt, synthetic construct
  misc_feature 1..1680: note = derived and/or modified CDS sequence (wt) from RVFV(Ken 199800523)__KU978777.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggccagaccaagagggagctcaaaagctttgatatctctcagtgccccaagattggagggcacggtagtaagaagtgcactggggacgcagcattttgctctgcttatgaatgcactgctcagtatgccaatgccttttgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgaacctcatggattggttgtccgatcaacagggttcaagatatcatctgcagttgcttgtgctagcggagtttgcgtcacagggtcgcagagtccttctactgagattacactcaagtatccagggatatcccagtcctctgggggggacataggggttcacatggcacatgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccattaatgtggattacagccttcatcagatgggtgtataagaagatggttgctagagtggcggacaatattaatcaagtgaacagggaaataggatggatggaaggaggtcagttggttctagggaaccctgcccctattcctcgtcatgccccaatcccacgttatagcacatacctaatgctactattgattgtctcatatgcatcagca

SEQ ID NO: 4569 - RNA, 1680 nt, synthetic construct
  misc_feature 1..1680: note = derived and/or modified CDS sequence (wt) from RVFV(1853/78)__DQ380220.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgacccaggaggatgccacatgcaaacctgtgacatatgctggggcatgtagcagttttgatgtcttgcttgagaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaagactgcaacttttgtagacagatgacaggtgctagcctaaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttacctcgataagcttgacctcaagactgaggagaatctgctaccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcaggggttgtgcagatacaagtgtcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagtccttctaccgagattacactcaagtatccagggatatcccagtcctctgggggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtgttcagttctattgcaataatttgtttagctattctttatagggtgctcaaatgcttaaagattgccccaaggaaagttctgaatccactaatgtggattacagccttcatcagatgggtgtataagaagatggttgccagagtggcagacaatattaatcaagtgaacagggagataggatggatggaaggaggtcagttggttctaggaaaccctgcccctattcctcgtcatgccccaattccacgttatagcacatacctaatgctactactaattgtctcatatgcatcagca

SEQ ID NO: 4570 - RNA, 1680 nt, synthetic construct
  misc_feature 1..1680: note = derived and/or modified CDS sequence (wt) from RVFV(73HB1449)__DQ380211.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcccctcttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcacagaggactgcaacttttgtaggcagatgacaggtgctagcctgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcacaagggacagtataagggaacaatggactctggtcagactaagagggagctcaaaagctttgatatttctcagtgccccaagattggaggacatggtagtaagaagtgcactggggacgcagcattttgctctgcttatgagtgcactgctcagtatgccaatgcttattgttcacatgctaatgggtcagggattgtgcagatacaagtatcaggggtctggaagaagcctttatgtgtagggtatgagagagtggttgtgaagagagaactctctgccaagcccatccagagggttgagccttgcacaacttgtataaccaaatgtgagcctcatggattggttgtccgatcaacagggttcaagatatcatctgcagttgcttgtgctagcggagtttgcgtcacaggatcgcagaatccttccaccgagatcacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgttcgtgttcagttctattgcaataatttgtttagctattctttatagggtgctcaagtgcctaaagattgccccaaggaaagttctgaatccactaatgtggattacagccttcatcagatgggtgtataagaagatggttgccagagtggcagacaatattaatcaagtgaatagggaaataggatggatggaaggaggtcagttggtcctagggaaccctgcccctattcctcgccatgccccaattccacgttatagcacatacctaatgctactattgattgtctcatatgcatcagca

SEQ ID NO: 4571 - RNA, 1680 nt, synthetic construct
  misc_feature 1..1680: note = derived and/or modified CDS sequence (wt) from RVFV(2007000234)__JF326191.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagca

SEQ ID NO: 4572 - RNA, 1680 nt, synthetic construct
  misc_feature 1..1680: note = derived and/or modified CDS sequence (wt) from RVFV(73HB1230)__DQ380221.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcccaagtatgagctcactgaggactgcaacttttgtaggcagatgacaggtgctagcctgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagactaagaaggagctcaaaagctttgatatctctcagtgccccaagattggaggacatggtagtaagaagtgcactggggacgcagcattttgctctgcttatgagtgcactgctcagtacgccaatgcctattgttcgcatgctaatggttcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagtccttctaccgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgctccaaggaaagttctgaatccactaatgtggattacagccttcatcagatgggtgtataagaagatggttgctagagtggcagacaatattaatcaagtgaacagggaaataggatggatggaaggaggtcagttggtcctagggaaccctgcccctattcctcgtcatgccccaatcccacgttatagcacatacctaatgctactattgattgtctcatatgcatcagca

SEQ ID NO: 4573 - RNA, 1680 nt, synthetic construct
  misc_feature 1..1680: note = derived and/or modified CDS sequence (wt) from RVFV(ZM-657)__DQ380204.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaaagcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagca

SEQ ID NO: 4574 - RNA, 1680 nt, synthetic construct
  misc_feature 1..1680: note = derived and/or modified CDS sequence (wt) from RVFV(Kenya 83 (21445))__DQ380198.1__Gn
  source 1..1680: mol_type = other RNA
atggcagggattgcaatgacagtccttccagccttagcagtttttgctttggcacctgttgtttttgctgaagacccccacctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaactcgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaaaaaggggtcttaccctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgtttcgagcataagggacagtataaaggaacaatggactctggtcagaccaagagggagctcaaaagctttgatatctctcagtgccccaagattggagggcatggtagtaagaagtgcactggggacgcagcattctgctctgcttatgagtgcactgctcagtacgccaatgcctattgttcacatgctaatgggtcagggattgtgcagattcaagtatcaggggtctggaagaagcctttatgtgtagggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgctagcggggtttgcgtcacaggatcgcagagtccttctactgagattacactcaagtatccagggatatctcagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagctttcatcagatgggtgtataagaagatggttgctagagtggcagacaacattaatcaagtgaacagggaaataggatggatggaaggaggtcagttggctctagggaaccctgcccctattcctcgtcatgccccaatcccacgttatagcacatacctaatgctactattgattgtctcatatgcatcagca

SEQ ID NO: 4575 - RNA, 1680 nt, synthetic construct
  misc_feature 1..1680: note = derived and/or modified CDS sequence (wt) from RVFV(SAUDI 200010901)__KU978778.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcctcttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggagttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggccagaccaagagggagctcaaaagctttgatatctctcagtgccccaagattggagggcatggtagtaagaagtgcactggggacgcagcattttgctctgcttatgaatgcactgctcagtatgccaatgccttttgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgaacctcatggattggttgtccgatcaacagggttcaagatatcatctgcagttgcttgtgctagcggagtttgcgtcacagggtcgcagagtccttctactgagattacactcaagtatccagggatatcccagtcctctgggggggacataggggttcacatggcacatgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccattaatgtggattacagccttcatcagatgggtgtataagaagatggttgctagagtggcggacaatattaatcaagtgaacagggaaataggatggatggaaggaggtcagttggttctagggaaccctgcccctattcctcgtcatgccccaatcccacgttatagcacatacctaatgctgctattgattatctcatatgcatcagca

SEQ ID NO: 4576 - RNA, 1680 nt, synthetic construct
  misc_feature 1..1680: note = derived and/or modified CDS sequence (wt) from RVFV(2007004194)__EU574031.1__Gn
  source 1..1680: mol_type = other RNA
atggcagggattgcgatgacagtccttccagccttagcagtttttgctttggcacctgttgtctttgctgaagacccccatctcagaaacagaccagggaaaggacacaactacattgacgggatgactcaggaggatgccacatgcaaacctgtgacatatgctggggcatgtagcagttttgatgtcttgcttgaaaaggggaaatttccccttttccagtcatatgctcatcatagaactctgctagaggcagttcatgacaccatcattgcaaaggctgatccacctagctgtgacctccagagtgctcatgggaatccctgtatgaaagagaaacttgtgatgaagacacattgtcctaacgactaccagtcagctcattacctcagcaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggatgcagcattttgctctgcttatgaatgtactgctcagtatgccaatgcctattgttcacatgctaatgggtcagggattgtgcagattcaagtatcaggggtctggaagaaacctttatgtgtggggtatgagagagtggttgtgaagagagaactctcagccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccccgcccctattcctcgtcatgccccaatcccacgttatagcacatacctaatgctactactgattgtctcatatgcatcagca

SEQ ID NO: 4577 - RNA, 1680 nt, synthetic construct
  misc_feature 1..1680: note = derived and/or modified CDS sequence (wt) from RVFV(ZH-501-777)__DQ380202.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggaccctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagca

SEQ ID NO: 4578 - RNA, 1680 nt, synthetic construct
  misc_feature 1..1680: note = derived and/or modified CDS sequence (wt) from RVFV(ZC-3349)__DQ380207.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctactgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcaggcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagcctttatcagatggatatataagaagatggttgccagagtggcagacaacattaatcacgtgaacagggaaataggatggatggaaggaggtcagttggttctagggaaccctgcccctattcctcgtcatgccccaatcccacgttatagcacatacctgatgttattattgattgtctcatatgcatcagca

SEQ ID NO: 4579 - RNA, 1680 nt, synthetic construct
  misc_feature 1..1680: note = derived and/or modified CDS sequence (wt) from RVFV(200803166)__JF311381.1__Gn
  source 1..1680: mol_type = other RNA
atggcagggattgcgatgacagtccttccagccctagcggtttttgctttagcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttaaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggatccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagggaaataggatggatggaaggaggtcagttggttctagggaaccctgcccctattcctcgtcatgccccaatcccacgttatagcacatacctaatgctactattgattgtctcatatgcaacagca

SEQ ID NO: 4580 - RNA, 1680 nt, synthetic construct
  misc_feature 1..1680: note = derived and/or modified CDS sequence (wt) from RVFV(1260/78)__DQ380214.1__Gn
  source 1..1680: mol_type = other RNA
atggcagggattgcaatgacagtccttccagccttagcagtttttgctctagcacctgttgtttttgctgaagacccccatctcagaaacagaccggggaaggggcacaactacattgacgggatgactcaggaggatgccacatgcaaacctgtgacatatgctggggcatgtagcagttttgatgtcttgcttgaaaaagggaaatttcccctcttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcacagaggactgcaacttttgtaggcagatgacaggtgctagcctgaagaaggggtcttatcctctccaagacttattttgtcagtcaagtgaggacgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcacaagggacagtataagggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcttattgttcacatgctaatgggtcagggattgtgcaaatacaagtatcaggggtctggaagaagcctttatgtgtagggtatgagagagtggttgtaaagagagaactctctgccaagcccatccagagagttgagccttgcacaacttgtataaccaaatgtgagcctcatggattggttgtccgatcaacagggttcaaaatatcatctgcagttgcttgtgctagcggagtttgcgtcacaggatcgcagagtccttccaccgagattacactcaagtatccagggatatcccagtcctctgggggggacataggggttcacatggcacatgatgaccagtcagttagctccaaaatagtagctcactgccctccccaggacccgtgcttagtgcatggctgcatagtgtgtgctcatggcctgataaattaccagtgtcacactgctctcagtgcctttgttgttgtgtttgtgttcagttctattgcaataatttgtttagctattcttcatagggtgctcaagtgcttaaagattgccccaaggaaggttctgaatccactaatgtggattacagccttcatcagatgggtgtataagaagatggttgccagagtggcagacaatattaatcaagtgaacagggaaataggatggatggaaggaggtcagttggttctagggaaccctgcccctattcctcgccatgccccaattccacgttatagcacatacctaatgctactattgattgtctcatatgcatcagca

SEQ ID NO: 4581 - RNA, 1680 nt, synthetic construct
  misc_feature 1..1680: note = derived and/or modified CDS sequence (wt) from RVFV(T-46 (228113))__DQ380199.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaaaggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagca

SEQ ID NO: 4582 - RNA, 1680 nt, synthetic construct
  misc_feature 1..1680: note = derived and/or modified CDS sequence (wt) from RVFV(ZINGA J83 R1)__KU978776.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgagaaggggaaattcccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggctgatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttaccttgataagcttgacctcaagactgaggagaatctgctaccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtagttgtgaagagagaactctctgccaagcccatccagagagttgagccttgcacaacttgtataaccaaatgtgagcctcatgggttggttgtccgatcaacagggttcaagatatcatctgcagttgcttgtgctagcggagtttgcgtcacaggatcgcagagtccttccaccgagattacactcaagtatccagggatatcccagtcctctggaggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgccccaaggaaagttctgaatccactaatgtggattacagccttcatcagatgggtgtataggaagatggttgccagagtggcagacaatattaatcaagtgaacagggagataggatggatggaaggaggtcagttggttctagggaaccctgcccctattcctcgtcatgttccaattccacgttatagcacatacctaatgctactactgattgtctcatatgcatcagca

SEQ ID NO: 4583 - RNA, 1680 nt, synthetic construct
  misc_feature 1..1680: note = derived and/or modified CDS sequence (wt) from RVFV(clone 13)__DQ380213.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcccctcttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagcatgagctcacagaggactgcaacttttgtaggcagatgacaggtgctagcctgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcacaagggacagtataagggaacaatggactctggtcagactaagagggagctcaaaagctttgatatttctcagtgccccaagattggaggacatggtagtaagaagtgcactggggacgcagcattttgctctgcttatgagtgcactgctcagtatgccaatgcttattgttcacatgctaatgggtcagggattgtgcagatacaagtatcaggggtctggaagaagcctttatgtgtagggtatgagagagtggttgtgaagagagaactctctgccaagcccatccagagggttgagccttgcacaacttgtataaccaaatgtgagcctcatggattggttgtccgatcaacagggttcaagatatcatctgcagttgcttgtgctagcggagtttgcgtcacaggatcgcagaatccttccaccgagatcacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgttcgtgttcagttctattgcaataatttgtttagctattctttatagggtgctcaagtgcctaaagattgccccaaggaaagttctgaatccactaatgtggattacagccttcatcagatgggtgtataagaagatggttgccagagtggcagacaatattaatcaagtgaatagggaaataggatggatggaaggaggtcagttggtcctagggaaccctgcccctattcctcgccatgccccaattccacgttatagcacatacctaatgctactattgattgtctcatatgcatcagca

SEQ ID NO: 4584 - RNA, 1680 nt, synthetic construct
  misc_feature 1..1680: note = derived and/or modified CDS sequence (wt) from RVFV(SA01-1322)__KX096942.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttcctcttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtaggagttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggccagaccaagagggagctcaaaagctttgatatctctcagtgccccaagattggagggcatggtagtaagaagtgcactggggacgcagcattttgctctgcttatgaatgcactgctcagtatgccaatgccttttgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgaacctcatggattggttgtccgatcaacagggttcaagatatcatctgcagttgcttgtgctagcggagtttgcgtcacagggtcgcagagtccttctactgagattacactcaagtatccagggatatcccagtcctctgggggggacataggggttcacatggcacatgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccattaatgtggattacagccttcatcagatgggtgtataagaagatggttgctagagtggcggacaatattaatcaagtgaacagggaaataggatggatggaaggaggtcagttggttctaggggaccctgcccctattcctcgtcatgccccaatcccacgttatagcacatacctaatgctgctattgattatctcatatgcatcagca

SEQ ID NO: 4585 - RNA, 1680 nt, synthetic construct
  misc_feature 1..1680: note = derived and/or modified CDS sequence (wt) from RVFV(25010-24)__KM210509.1__Gn
  source 1..1680: mol_type = other RNA
atggcagggattgcaatgacagtccttccagccttagcagtttttgctttggcacctgttgtctttgccgaagaccctcatcttagaaacaggccaggaaagggacacaactacattgacgggatgactcaggaggatgccacatgtaaacctgtgacatatgctggggcatgtagcagttttgatgtcttgctcgaaaagggaaaatttcccctcttccagtcatacgctcatcatagaactctactagaggccgtccacgacaccattattgcaaaggctgatccacctagctgtgaccttcagagtgctcatgggaatccctgcatgaaggagaaactcgtgatgaagacacactgtccaaatgactaccagtcagctcattaccttaacaatgacgggaaaatggcctcagtcaagtgccctcctaagtatgagctcactgaggactgcaacttttgtaggcagatgacaggtgctagcctgaagaaagggtcttatcctctccaggacttattttgtcagtcaagtgaggatgatgggtcaaaattaaaaacaaaaatgaaaggggtctgcgaagtgggagttcaagcactcaaaaagtgtgatggccaactcagcactgcacatgaggttgtgccctttgcagtatttaagaactcaaagaaggtttatcttgacaagcttgacctcaagactgaggaaaatctgctaccagactcatttgtctgcttcgagcataaggggcagtataaaggaacaatggactctggtcagacaaagagggagctcaaaagctttgatatctctcagtgtcccaagattggagggcatggtagcaagaaatgtactggggacgcagcattctgctctgcttatgagtgcactgctcaatacgccaatgcctattgttcacatgctaatgggtcaggaattgtacagatacaagtatccggggtctggaagaagcctttgtgtgtagggtatgagagagtggttgtgaagagagagctctctgccaagcccatccagagagttgagccttgcacaacttgtataaccaaatgtgagcctcatggattaattgtccgatcaacagggttcaagatatcatctgcagttgcttgtgctagcggagtttgcgtcacaggatcgcagagcccgtctactgagatcacactcaagtacccagggatatcccagtcctctgggggggacataggggttcacatggcacatgatgatcagtcagttagctccaaaatagtagctcactgccccccccaggacccgtgcctagtgcatggctgcatagtgtgtgctcatggcttgataaattaccagtgtcacactgctctcagtgcctttgtcgttgtgttcgtgttcagctctgttgcaataatttgtttggctattctttataaggtgctcaagtgcctaaaaattgccccaaagaaagttctaaatccactgatgtggattactgctttcatcagatgggtgtataagaagatggttgccagagtggcagacaatatcaatcaagtgaacagggaaataggatggatggaaggaggccagttagctctagggaatcctgctcctatccctcgtcatgctccaattccacgttatagcacatacctaatgctactattgattgtctcatatgcatcagca

SEQ ID NO: 4586 - RNA, 1680 nt, synthetic construct
  misc_feature 1..1680: note = derived and/or modified CDS sequence (wt) from RVFV(200803162)__JF311377.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaaatatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtatagccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctaaggaaccctgcccctattcctcgtcatgccccaatcccacgttatagcacatacctaatgctactattgattgtctcatatgcatcagca

SEQ ID NO: 4587 - RNA, 1680 nt, synthetic construct
  misc_feature 1..1680: note = derived and/or modified CDS sequence (wt) from RVFV(2007002476)__EU574036.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcaaatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagca

SEQ ID NO: 4588 - RNA, 1680 nt, synthetic construct
  misc_feature 1..1680: note = derived and/or modified CDS sequence (wt) from RVFV(Hv-B375)__DQ380218.1__Gn
  source 1..1680: mol_type = other RNA
atggcagggattgcaatgacagtccttccagccttggcagtttttgctttggcacctgttgtttttgctgaggacccccatctcagaaacagaccagggaaggggcacaactacattgacgggatgacccaggaggatgccacatgcaaacctgtgacatatgctggggcatgtagcagttttgatgtcttgcttgagaaggggaaatttccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagaatgagctcactgaggactgcaacttttgtaggcagatgacaggtgctagcctaaagaaggggtcttatcctctccaagacttattttgccagtcaagtgaggatgatggatcaaaattaaaaacaaaaatgaaaggggtctgcgaagtgggggtccaagcactcaaaaagtgtgatggccaactcagcaccgcacatgaggttgtgccctttgcagtgttcaagaactcaaagaaggtttacctcgataagcttgacctcaagactgaggagaatctgctgccagactcatttgtctgcttcgagcataagggacagtataaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtgtcaggggtctggaagaagcctttatgtgtagggtatgagagagtggttgtgaagagagaactctctgccaagcccatccagagagttgagccttgcacaacttgtataaccaaatgtgagcctcatggtttggttgtccgatcaacagggttcaagatatcatctgcagttgcttgtgctagcggagtttgcgtcacaggatcacagagcccttctaccgagattacactcaagtatccagggatatcccagtcctctgggggggacataggggttcacatggcacacgatgatcagtcagttagctccaaaatagtagctcactgccctccccaggacccatgcttagtgcacggctgcatagtgtgtgctcatggcctgataaattaccagtgtcacactgccctcagtgcctttgttgttgtgtttgtattcagttctattgcaataatttgtttagccattctttatagggtgctcaagtgcttaaagattgccccaaggaaagttctgaatccactaatgtggatcacagccttcatcagatgggtgtataagaagatggttgccagagtggcagacaatattaatcaagtgaacagggagataggatggatggaaggaggtcagttggttctagggaaccctgctcctattcctcgtcatgccccaattccacgttatagcacatacctaatgctactgctaattgtctcatatgcatcagca

SEQ ID NO: 4589 - RNA, 1680 nt, synthetic construct
  misc_feature 1..1680: note = derived and/or modified CDS sequence (wt) from RVFV(OS-1)__DQ380186.1__Gn
  source 1..1680: mol_type = other RNA
atggcagggattgcaatgacagtccttccagccttagcagtttttgctttggcacctgttgtatttgctgaagacccccatctcagaaatagaccagggaaggggcacaactacattgacgggatgactcaggaggatgccacttgtaaacctgtgacatatgctggggcatgtagcagttttgatgtcttgctcgaaaagggaaaattccccctcttccagtcgtatgctcatcatagaactctactagaggcagttcatgacaccatcattgcaaaggctgatccacctagttgtgatcttcagagtgctcatgggaatccttgcatgaaagagaaactcgtgatgaagacacactgtccaaatgactaccagtcagcccactacctcaacaatgatgggaaaatggcctcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaggcactcaagaagtgtgatggccagctcagcactgcacatgaggttgtgccctttgcagtgtttaagaactcaaagaaggtttatcttgacaagcttgacctcaaaactgaagaaaatctgctaccagactcatttgtctgcttcgagcataagggacagtataaaggaacaatggactctggtcaaactaagagggagctcaaaagctttgatatctctcagtgccccaagattggaggacatggtagcaagaagtgcactggggacgcagcattttgctctgcttatgagtgcactgctcaatacgccaatgcctattgttcacatgctaatgggtcaggagttgtgcagatacaagtatccggggtctggaagaaacctttatgtgtagggtatgagagagtggttgtgaagagagaactctctgccaaacccatccagagagttgagccttgcacaacctgtataaccaaatgtgagcctcatggattggttgtccgatcaacagggttcaagatatcatctgcagttgcatgtgctagcggagtttgtgtcacaggatcgcagagtccttctaccgagatcacactcaagtatccagggatatcccagtcctctgggggggacataggggttcacatggcacacgatgatcagtcagttagctccaaaatagtagctcactgccctccccaggacccgtgcctagtgcatggctgcatagtgtgtgctcatggcctaataaattaccagtgtcacactgctctcagtgcctttgttgttgtgttcgtattcagctctgttgcaataatttgtttggccattctttataaggtgctcaagtgcctaaagattgccccaaggaaagttctaaatccactaatgtggattactgccttcatcagatgggtgtataagaagatggttgccagggtggcagacaatattaatcaagtgaacagagaaataggatggatggagggaggtcagttggctctagggaaccctgcccctattcctcgtcatgccccaattccacgttatagcacatacctgatgctactattgattgtctcatatgcatcagca

SEQ ID NO: 4590 - RNA, 1680 nt, synthetic construct
  misc_feature 1..1680: note = derived and/or modified CDS sequence (wt) from RVFV(2373/74)__DQ380194.1__Gn
  source 1..1680: mol_type = other RNA
atggcagggattgcaatgacagtccttccagccttagcagtttttgctttggcacctgttgtttttgctgaagaccctcatctcagaaacagaccagggaaggggcacaactacattgacgggatgactcaggaggatgccacatgtaaacctgtgacatatgctggggcatgtagcagttttgatgtcttgctcgaaaagggaaaattccccctcttccagtcatatgctcatcatagaactctactagaggcagttcacgacaccatcattgcaaaggctgacccacctagctgtgacctccagagtgctcatgggaatccctgcatgaaagagaaactcgtgatgaagacacactgcccaaatgactaccagtcagctcattacctcaacaatgacgggaaaatggcttcagtcaagtgccctcctaagtatgagctcactgaggactgcaacttttgtaggcagatgacaggtgctagcttgaagaaggggtcttatcctctccaggacttgttctgtcaatcaagtgaggatgatggatcaaaattaaaaacaaaaatgaaaggggtctgcgaagtgggggttcaagcactcaaaaagtgtgatggccaactcagcactgcacatgaggttgtgccatttgcagtgtttaaaaactcaaagaaggtttatcttgacaagcttgacctcaagactgaggaaaatctgctaccagactcatttgtctgcttcgagcataagggacagtataaagggacaatggactctggtcagactaagagggagctcaaaagttttgatatctctcagtgccccaagattggaggacatggtagcaagaagtgcactggggacgcagcattttgctctgcttatgagtgcactgctcaatacgccaatgcctattgttcacatgctaatgggtcaggaattgtacagatacaagtatccggggtctggaagaagcctttatgtgtaggatatgagagagtggttgtgaagagagaactctctgctaagcccatccagagagttgagccttgcacaacttgtataaccaaatgcgagcctcatgggttggttgtccgatcaacagggttcaagatatcttctgcagttgcttgtgctagcggagtttgcgtcacaggatcacagagcccttctaccgagattacactcaagtatccaggaatatcccagtcctctgggggggacataggggttcacatggcacatgatgatcagtcagttagctccaaaatggtagctcactgccccccccaggacccgtgcctagtgcatggctgcatagtgtgtgctcatggcttgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcaggtgggtgtataagaagatggttgccagagtggcagacaatatcaatcaagtgaacagggaaataggatggatggaaggaggccagttggctctagggaaccctgcccctattcctcgtcatgccccaattccacgttatagcacatacctaatgctactattgattgtctcatatgcatcagca

SEQ ID NO: 4591 - RNA, 1680 nt, synthetic construct
  misc_feature 1..1680: note = derived and/or modified CDS sequence (wt) from RVFV(Kenya 57 (Rintoul))__DQ380192.1__Gn
  source 1..1680: mol_type = other RNA
atggcagggattgcaatgacagtccttccagccttagcagtttttgctttggcacctgttgtttttgctgaagaccctcatctcagaaacagaccagggaagggacacaactacattgacgggatgactcaggaggatgccacatgtaaacctgtgacatatgctggggcatgtagcagttttgatgtcttgctcgaaaagggaaaatttcccctcttccagtcgtatgctcatcatagaactctattagaggcagttcacgacaccatcattgcaaaggctgatccacctagctgtgaccttcagagtgctcatgggaatccctgcatgaaagagaaactcgtaatgaagacacactgtccaaatgactaccagtcagctcattacctcaacaatgacgggaaaatggcttcagtcaagtgccctcctaagtatgagctcactgaggactgcaacttttgtaggcagatgacaggtgctagcttgaagaaggggtcttatcctctccaagacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgacaagcttgacctcaagactgaggaaaatctgctaccagactcatttgtctgcttcgagcataagggacagtacaaaggaacaatggactctggtcagattaagagggagctcaaaagctttgatatctctcagtgccccaagattggaggacatggtagcaagaagtgcactggggacgcagcattttgctctgcttatgagtgtactgctcaatacgccaatgcctattgttcacatgctaatgggtcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctactgagattacactcaagtatccagggatatcccagtcctctgggggagacataggggttcacatggcacatgatgatcagtcagttagctccaaaatagtagctcactgccccccccaggacccgtgcctagtgcatggctgcatagtgtgtgctcatggcttgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcagatgggtgtataagaagatggttgccagagtggcagacaatatcaatcaagtgaacagggaaataggatggatggaaggaggccagttggttctagggaaccctgcccctattcctcgtcatgctccaattccacgttatagcacatacctaatgctgctattgattgtctcatatgcatcagca

SEQ ID NO: 4592 - RNA, 1680 nt, synthetic construct
  misc_feature 1..1680: note = derived and/or modified CDS sequence (wt) from RVFV(Sudan 2V-2007)__JQ820490.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgacctccagagtgctcatgggaatccctgtatgaaagagaaacttgtgatgaagacacattgtccaaatgactaccagtcagctcattacctcaacaatgacgggaaaatggcctcagtcaagtgcccacctaagtatgagctcactgaggactgcaacttttgtagacagatgacaggtgctagcctgaagaaggggtcttatcctctccaagacttattttgtcagtcgagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtctatcttgataagcttgacctcaagactgaggagaatctgctaccagactcatttgtctgcttcgagcataagggacagtataaaggaacaatggactctggtcagaccaagagggagctcaagagctttgatatctctcagtgccccaagattggagggcatggtagtaagaagtgcactggggatgcagcattttgctctgcttatgaatgcactgctcagtatgccaatgcctattgttcacatgctaatgggtcagggattgtgcagattcaagtatcaggggtctggaagaaacctttgtgtgtagggtatgagagagtggttgtgaagagagaactctctgccaaacccatccagagagttgagccttgcacaacttgcataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggatataggggttcacatggcacacgatgatcagtcagttagctccaaaatagtagctcactgccccccccaggacccgtgctcagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagagaaataggatggatggaaggaggtcagttggttctagggaaccctgcccctattcctcgtcatgccccaatcccacgttatagcacatacctaatgctactattgattgtctcacatgcatcagca

SEQ ID NO: 4593 - RNA, 1680 nt, synthetic construct
  misc_feature 1..1680: note = derived and/or modified CDS sequence (wt) from RVFV(200803167)__JF311382.1__Gn
  source 1..1680: mol_type = other RNA
atggcagggattgcgatgacagtccttccagccttagcagtttttgctttggcacctgttgtttttgctgaagacctccatctcagaaacagaccagggaaggggcacaactacattgacgggatgactcaggaggatgccacatgcaaacctgtgacatatgctggggcatgtagcagttttgatgtcttgcttgaaaaggggaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtaggcagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaatgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattgcactcaagtatccagggatatcccagtcctctgggggggatataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgttgtatttgtattcagttctattgcaataatttgcttagctattctttatagggtgctcaagtgcctaaagattgccccaaggaaagttctgaatccactaatgtggattacagccttcatcagatgggtgtataagaagatggttgctagagtggcggacaatattaatcaagtgaacagggaaataggatggatggaagggggtcagttggttctagggaaccctgcccctattcctcgtcatgccccaatcccacgttatagcacatacctaatgctactattgattgtctcatatgcatcagca

SEQ ID NO: 4594 - RNA, 1680 nt, synthetic construct
  misc_feature 1..1680: note = derived and/or modified CDS sequence (wt) from RVFV(KEN/Gar-008/06)__HM586965.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaagggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagca

SEQ ID NO: 4595 - RNA, 1680 nt, synthetic construct
  misc_feature 1..1680: note = derived and/or modified CDS sequence (wt) from RVFV(ANK-6087)__DQ380216.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgagaaggggaaattcccccttttccagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttaccttgataagcttgacctcaagactgaggagaatctgctaccagactcatttgtctgcttcgagcataagggacagtataaaggaaaattggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtagttgtgaagagagaactctctgccaagcccatccagagagttgagccttgcacaacttgtataaccaaatgtgagcctcatgggttggttgtccgatcaacagggttcaagatatcatctgcagttgcttgtgctagcggagtttgcgtcacaggatcgcagagtccttccaccgagattacactcaagtatccagggatatcccagtcctctggaggggacataggggttcacatggcacacgatgatcagtcagttagctccaaaatagtagctcactgccctccccaggacccgtgcttagtgcacggctgcatagtgtgtgctcatggcctgataaattaccagtgtcacactgctctcagtgcctttgttgttgtgtttgtattcagttctattgcaataatttgtttagctattctttatagggtgctcaagtgcctaaagattgccccaaggaaagttctgaatccactaatgtggattacagccttcatcagatgggtgtataggaagatggttgccagagtggcagacaatattaatcaagtgaacagggagataggatggatggaaggaggtcagttggttctagggaaccctgcccctattcctcgtcatgttccaattccacgttatagcacatacctaatgctactactgattgtctcatatgcatcagca

SEQ ID NO: 4596 - RNA, 1680 nt, synthetic construct
  misc_feature 1..1680: note = derived and/or modified CDS sequence (wt) from RVFV(763/70)__DQ380188.1__Gn
  source 1..1680: mol_type = other RNA
atggcagggattgcaatgacagtccttccagccttagcagtttttgctttggcacctgttgtttttgctgaagaccctcatctcagaaacagaccagggaaggggcacaactacattgacgggatgactcaggaggacgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccctgcatgaaggagaaactcgtgatgaagacacactgtccaaatgactaccagtcagctcattacctcaacaatgacgggaaaatggcttcagtcaagtgccctcctaaatatgggctcactgaggactgcaatttttgcaggcagatgacaggtgctagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctcaaaagctttgatatctctcagtgccccaagattggaggacatggtagcaagaagtgcactggggacgcagctttttgctctgcttatgagtgcactgctcaatacgccaatgcttattgttcacatgctaatgggtcaggaattgtacagatacaagtatccggggtctggaagaagcctttgtgtgtcgggtatgagagggtggttgtgaagagagaactctctgctaagcccatccagagagttgagccttgcacaacttgtataaccaaatgtgagcctcacggattggttgtccgatcaacaggtttcaagatatcatctgcagttgcttgtgctagcggagtttgcgttacaggatcgcagagcccttctaccgagatcacactcaagtatccagggatatcccagtcctctgggggggacataggggttcacatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctgaatccactaatgtggattactgctttcatcagatgggtgtataagaagatggttgccagagtggcagacaatatcaatcaggtgaacagggaaataggatggatggaaggaggccagctggctctagggaaccctgcccctattcctcgtcatgctccaattccacgttatagcacatacttaatgctactattgattgtctcatatgcatcagca

SEQ ID NO: 4597 - RNA, 1680 nt, synthetic construct
  misc_feature 1..1680: note = derived and/or modified CDS sequence (wt) from RVFV(BIME-01)__KX609032.1__Gn
  source 1..1680: mol_type = other RNA
atggcagggattgcaatgacagttcttcccgccttagcagtttttgctttggcacctgttgtttttgctgaggaccctcatctcagaaacagaccagggaagggacataactacattgacgggatgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgatccacctagctgtgatctccagagtgctcatgggaatccctgcatgaaagagaaactcgtgatgaagacacactgtccaaatgactaccagtcagctcattacctcaacaatgacgggaaaatggcttcagtcaagtgccctcctaagtatgagcttactgaggactgcaacttttgtaggcagatgacaggtgctagcttgaagaaggggtcttatcctctccaggacttattttgtcagtcaagtgaggatgatggatcaaaactaaagacaaaaatgaaaggggtctgcgaagtgggggttcaggcactcaaaaagtgtgatggccaactcagcactgcacatgaggttgtgccctttgcagtgtttaagaattcaaagaaggtttatcttgacaagcttgaccttaagactgaagaaaatctgctaccagactcatttgtctgctttgagcataagggacagtataaaggaacaatggactctggtcagactaagagggagctcaaaagctttgatatctctcagtgccccaagattgggggacatggtagcaagaagtgcactggggacgcagcattttgctctgcttatgagtgtactgctcaatatgccaatgcctattgttcacatgctaatgggtctgggattgtacagatacaagtatccggggtctggaagaagcctttatgtgtggggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgccagcggagtttgcgtcacaggatcgcagagcccttctactgagatcactctcaagtatccagggatatcccagtcctctgggggggatataggggttcacatggcacatgatgatcagtcagttagctccaaaatagtggctcactgccccccccaggacccgtgcctagtgcatggctgcatagtgtgtgctcatggcttgataaattaccagtgtcacactgctcttagtgcttttgttgttgtgttcgtattcagctctgttgcaataatttgtctggccattctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgctcccattcctcgtcatgctccgattccacgttatagcacatacctaatgctactattgattatctcatatgcatcagca

SEQ ID NO: 4598 - RNA, 1680 nt, synthetic construct
  misc_feature 1..1680: note = derived and/or modified CDS sequence (wt) from RVFV(KEN07-KUR340)__EF460404.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgacccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgacatctctcagtgccccaagattggagggcatggtagtaagaagtgcactggggacgcagcattctgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttataggatgctcaagtgcttaaagattgccccaaggatagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagca

SEQ ID NO: 4599 - RNA, 1680 nt, synthetic construct
  misc_feature 1..1680: note = derived and/or modified CDS sequence (wt) from RVFV(SA-51 (Van Wyck))__DQ380195.1__Gn
  source 1..1680: mol_type = other RNA
atggcagggattgcaatgacagtccttccagccttagcagtttttgctttggcacctgttgtttttgctgaagacccccatctcagaaacagaccagggaagggacacaactacattgacgggatgactcaggaggatgccacatgtaaacctgtgacatatgctggggcatgtagcagttttgatgtcttgctcgaaaagggaaaatttcccctttttcagtcgtatgctcatcatagaactctactagaggcagttcacgacaccatcattgcaaaggctgatccacctagctgtgaccttcagagtgctcatgggaatccctgcatgaaagagaaactcgtgatgaagacacactgtccaaatgactaccagtcagctcattacctcaacaacgacgggaaaatggcttcagtcaagtgccctcctaagtatgagctcactgaggactgcaacttttgtaggcagatgacaggtgctagcctgaagaaggggtcttatcctctccaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgacctcaaaactgaggaaaatctgctaccagactcatttgtctgcttcgagcataagggacagtataaaggaacaatggactctggtcagactaagagggagctcaagagctttgatatctctcagtgccccaagattggaggacgtggtagcaagaagtgcactggggacgcagcattttgctctgcttatgagtgcactgctcaatacgccaatgcctattgttcacatgctaatgggtcaggaattgtgcagatacaagtatcaggggtctggaagaagcctttatgtgtaggatatgagagagtggttgtgaaaagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctacagagattacactcaagtacccagggatatcccagtcctctggaggggacataggggttcacatggcacacgatgatcagtcagttagctccaaaatagtagctcactgccccccccaagacccgtgcttagtgcatggctgcatagtgtgtgctcatggcctgataaattaccagtgtcacactgctctcagtgcctttgttgttgtgttcgtattcagctctgttgcaataatctgtttagccattctttataaggtgctcaagtgcctaaagattgccccaaggaaagttctgaatccactaatgtggattactgccttcatcagatgggtgtataagaagatggttgccagagtggcagacaatattaatcaagtgaacagggagataggatggatggaaggaggtcagttggctctagggaatcctgcccctattcctcgtcatgctccaattccacgttatagcacatacctaatgctactattgattgtctcatatgcatcagca

SEQ ID NO: 4600 - RNA, 1680 nt, synthetic construct
  misc_feature 1..1680: note = derived and/or modified CDS sequence (wt) from RVFV(Lunyo)__KU167026.1__Gn
  source 1..1680: mol_type = other RNA
atggcagggattgcaatgacagtccttccagccttagcagtttttgctttggcacctgttgtttttgctgaagaccctcatctcagaaatagaccagggaaggggcacaactacattgacgggatgactcaggaggatgccacatgtaaacctgtgacatatgctggggcatgtagcagttttgatgtcttgcttgaaaagggaaaatttcccctcttccagtcgtatgctcatcatagaactctactggaggcagttcatgacaccatcattgcaaaggctgatccacctagctgtgaccttcagagtgctcatgggaatccctgcatgaaagagaaactcgtgatgaagacacactgtccaaatgactaccagtcagctcattacctcaacaatgacgggaaaatggcttcagtcaagtgccctcctaagtatgagctcactgaagactgcaacttttgtaggcagatgacaggtgctagcttgaagaaggggtcttatcccctccaggacctattttgtcagtcaagtgaggatgatggatcaaaattaaaaacaaaaatgaaaggggtctgcgaagttggggttcaagcactcaaaaagtgtgatggccaactcagcactgcacatgaggttgtgccctttgcagtgtttaagaactcaaagaaggtttatcttgataagcttgacctcaagactgaggaaaatctgctaccagactcatttgtctgcttcgagcacaagggacagtataaaggaacaatggtctctggtcagactaagagggagctcaaaagctttgatatctctcagtgtcccaagattggaggacatggtagcaagaagtgcactggggacgcagcattttgctctgcttatgagtgcactgctcaatatgccaatgcctattgctcacatgctaatggatcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccggtcaacagggttcaagatatcatctgcagttgcttgtgctagcggagtttgcgtcacaggatcgcagagtccttctaccgagattacactcaagtatccagggatatcccagtcctctgggggggacataggggttcacatggcacatgatgatcagtcagttagttccaaaatagtagctcactgccctccccaggacccgtgcctagtgcatggctgcatagtgtgtgctcatggcctgataaattaccagtgtcacactgctctcagtgcctttgttgttgtgttcgtattcagctctgttgcaataatttgtttggccattctttataaggtgctcaagtgcctaaagattgccccaaggaaagttctgaatccactaatgtggattactgccttcatcagatgggtgtataagaagatggttgccagagtggcagacaatatcaatcaagtgaacagggaaataggatggatggaaggaggtcagttggctctagggaaccctgcccctattcctcgtcatgctccaattccacgttatagcacatacctaatgctactattgattgtctcatatgcatcagca

SEQ ID NO: 4601 - RNA, 1680 nt, synthetic construct
  misc_feature 1..1680: note = derived and/or modified CDS sequence (wt) from RVFV(2269/74)__DQ380222.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgtaaacctgtgacatatgctggggcatgtagcagttttgatgtcttgctcgaaaaggggaaattccccctcttccagtcgtatgctcatcatagaactctactagaggcagttcacgacactatcattgcaaaggctgacccacctagctgtgaccttcagagtgctcatgggaatccctgcatgaaagagaagctcgtgatgaagacacactgtccaaatgactaccaatcagctcattaccttaacaatgacgggaaaatggcttcagtcaagtgcccccctaagtatgagctcactgaggattgcaacttttgtaggcagatgacaggtgctagcctgaagaaggggtcttatcctctccaggacttattttgtcagtcaagtgaggatgatgggtcaaaattaaaaacaaaaatgaaaggggtctgcgaagtgggagttcaagcactaaaaaagtgtgatggccaactcagcactgcacatgaggttgtgcccttcgcagtgtttaagaactcaaagaaggtttatcttgataagcttgaccttaagactgaggaaaatctgctaccagactcatttgtctgcttcgagcataaaggacaacataaaggaacaatggactctggtcagaccaagagggagctcaaaagctttgatatctctcagtgccccaagattggaggacatggtagcaagaagtgcactggggacgcagcattttgctctgcttatgagtgcactgctcagtacgccaatgcctattgttcacatgctaatgggtcaggaattgtgcagatacaagtgtcaggggtctggaagaagcctttatgtgtagggtatgagagagtggttgtaaagagagaactctctgccaagcccatccagagagttgagccttgcacaacttgtataaccaaatgcgagcctcatggactggttgtccgatcaacagggttcaagatatcatctgcagttgcttgtgctagcggagtttgcgtcacaggatcgcagagtccttctaccgagattacactcaagtatccaggaatatctcagtcctctgggggggacataggggttcacatggcacacgacgatcagtcagttagctccaaaatagtagctcactgccccccccaggacccgtgcttagtgcatggctgcatagtgtgtgctcatggcctgataaattaccagtgtcacactgctctcagtgcctttgttgttgtgttcgtgttcagctctgttgcaataatttgtttggccattctttataaggtgctcaagtgcctaaagattgccccaaagaaagttctgaatccgctaatgtggattactgccttcatcagatgggtatataagaagatggttgccagagtggcagataatataaatcaagtgaacagggaaataggatggatggaaggaggtcagttggctctagggaaccctgcccctattcctcgtcacgctccaatcccacgctatagcacatacctaatgctactactgattgtctcatatgcgtcagca

SEQ ID NO: 4602 - RNA, 1680 nt, synthetic construct
  misc_feature 1..1680: note = derived and/or modified CDS sequence (wt) from RVFV(MgH824)__DQ380210.1__Gn
  source 1..1680: mol_type = other RNA
atggcagggattgcaatgacagtccttccagccttagcagtttttgctttggcacctgttgtttttgctgaagacccccatctcagaaacagaccagggaaggggtacaactacattgacgggatgactcaggaggatgccacatgcaaacctgtgacatatgctggggcatgtagcagttttgatgtcttgcttgaaaaggggaaatttccccttttccagtcgtatgctcatcatagaactctactagaggcagttcacgacaccatcattgcaaaggctgacccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcgtaagggacagtacaaaggaacaatggactctggtcagactaagagggagctcaaaagctttgatatctctcagtgccccaagattggaggacatggtagtaagaagtgcactggggacgcagcattttgctctgcttatgagtgcactactcagtacgccaatgcctattgttcacatgctaatgggtcaggggttgtgcagatacaagtgtcaggggtctggaagaagcctttatgtgtaggatatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatggctgcatagtgtgtgctcatggcctgataaattaccagtgccacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaatattaatcaagtgaacagggaaataggatggatggaaggaggtcagttggttctagggaaccctgcccctattcctcgtcatgccccaatcccacgttatagcacatacctgatgttactattgattgtctcatatgcatcagca

SEQ ID NO: 4603 - RNA, 1680 nt, synthetic construct
  misc_feature 1..1680: note = derived and/or modified CDS sequence (wt) from RVFV__JQ068143.1__Gn
  source 1..1680: mol_type = other RNA
atggcagggattgcaatgacagtccttcccgccttagcagtttttgctttggcacctgttgtttttgctgaggaccctcatctcagaaacagaccagggaagggacacaactacattgacgggatgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgacccacctagctgtgatcttcagagtgctcatgggaacccctgcatgaaagagaaactcgtgatgaagacacactgtccaaatgactaccagtcagctcattatctcaacaatgacgggaaaatggcttcagtcaagtgccctcctaagtatgagctcactgaggactgcaacttttgtaggcagatgacaggtgctagcttgaagaaggggtcttatcctctccaggacttattttgtcagtcaagtgaggatgatgggtcaaaattaaagacaaaaatgaaaggggtctgcgaagtgggggttcaagcactcaaaaagtgtgatggccaactcagcactgcacatgaggttgtgccctttgcagtgtttaagaactcaaagaaggtttatcttgacaagcttgacctcaagactgaagaaaatctgctaccagactcatttgtctgctttgagcataaaggacagtataaaggaacaatagactctggtcagactaagagagagctcaaaagctttgatatctctcagtgccccaagattggaggacatggtagcaagaagtgcactggggacgcagcattttgctctgcttatgagtgtactgctcagtatgccaatgcctattgttcacatgctaatgggtctgggattgtacagatacaagtgtccggggtctggaagaagcctctgtgtgtaggatatgagagagtggttgtgaagagagaactctctgccaagcccatccagagagttgagccttgcacaacttgcataaccaaatgtgagcctcatggattggttgtccgatcaacagggtttaagatatcatctgcagttgcttgtgctagcggggtttgcgtcacaggatcgcagagcccttctactgagatcactcttaagtatccagggatatcccaatcctctgggggggacataggagttcacatggcacatgatgatcagtcagttagctccaaaatagtggctcactgccccccccaggacccgtgcctagtgcatggctgcatagtgtgtgctcatggcttgataaattaccagtgtcacactgctctcagtgcttttgttgttgtattcgtattcagctctgttgcaataatttgtctggccatcctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgctcctattcctcgtcatgctccaattccacgttatagcacgtatctaatgctactattgattatctcatatgcatcagca

SEQ ID NO: 4604 - RNA, 1680 nt, synthetic construct
  misc_feature 1..1680: note = derived and/or modified CDS sequence (wt) from RVFV(RVFBJ01/2016)__KX785331.1__Gn
  source 1..1680: mol_type = other RNA
atggcagggattgcaatgacagttcttcccgccttagcagtttttgctttggcacctgttgtttttgctgaggaccctcatctcagaaacagaccagggaagggacataactacattgacgggatgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgatccacctagctgtgatctccagagtgctcatgggaatccctgcatgaaagagaaactcgtgatgaagacacactgtccaaatgactaccagtcagctcattacctcaacaatgacgggaaaatggcttcagtcaagtgccctcctaagcatgagcttactgaggactgcaacttttgtaggcagatgacaggtgctagcttgaagaaggggtcttatcctctccaggacttattttgtcagtcaagtgaggatgatggatcaaaactaaagacaaaaatgaaaggggtctgcgaagtgggggttcaggcactcaaaaagtgtgatggccaactcagcactgcacatgaggttgtgccctttgcagtgtttaagaattcaaagaaggtttatcttgacaagcttgaccttaagactgaagaaaatctgctaccagactcatttgtctgctttgagcataagggacagtataaaggaacaatggactctggtcagactaagagggagctcaaaagctttgatatctctcagtgccccaagattgggggacatggtagcaagaagtgcactggggacgcagcattttgctctgcttatgagtgtactgctcaatatgccaatgcctattgttcacatgctaatgggtctgggattgtacagatacaagtatccggggtctggaagaagcctttatgtgtggggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgccagcggagtttgcgtcacaggatcgcagagcccttctactgagatcactctcaagtatccagggatatcccagtcctctgggggggatataggggttcacatggcacatgatgatcagtcagttagctccaaaatagtggctcactgccccccccaggacccgtgcctagtgcatggctgcatagtgtgtgctcatggcttgataaattaccagtgtcacactgctcttagtgcttttgttgttgtgttcgtattcagctctgttgcaataatttgtctggccattctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgcacccattcctcgtcatgctccgattccacgttatagcacatacctaatgctactattgattatctcatatgcatcagca

SEQ ID NO: 4605 - RNA, 1680 nt, synthetic construct
  misc_feature 1..1680: note = derived and/or modified CDS sequence (wt) from RVFV(KEN/Kil-006/07)__HM586966.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctgatggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagca

SEQ ID NO: 4606 - RNA, 1680 nt, synthetic construct
  misc_feature 1..1680: note = derived and/or modified CDS sequence (wt) from RVFV(SA-75)__DQ380189.1__Gn
  source 1..1680: mol_type = other RNA
atggcaaggattgcaatgacagtccttccagccttagcagtttttgctttggcacctgttgtttttgctgaagaccctcatctcagaaacagaccagggaaggggcacaactacattgacgggatgactcaggaggacgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccctgcatgaaggagaaactcgtgatgaagacacactgtccaaatgactaccagtcagctcattacctcaacaatgacgggaaaatggcttcagtcaagtgccctcctaaatatgagctcactgaggactgcaatttttgcaggcagatgacaggtgctagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctcaaaagctttgatatctctcagtgccccaagattggaggacatggtagcaagaagtgcactggggacgcagctttttgctctgcttatgagtgcactgctcaatacgccaatgcttattgttcacatgctaatgggtcaggagttgtacagatacaagtatccggggtctggaagaagcctttgtgtgtcgggtatgagagggtggttgtgaagagagaactctctgctaagcccatccagagagttgagccttgcacaacttgtataaccaaatgtgagcctcacggattggttgtccgatcaacaggtttcaagatatcatctgcagttgcttgtgctagcggagtttgcgttacaggatcgcagagcccttctaccgagattacactcaagtatccagggatatcccagtcctctgggggggacataggggttcacatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctgaatccactaatgtggattactgttttcatcagatgggtgtataagaagatggttgccagagtagcagacaatatcaatcaggtgaacagggaaataggatggatggaaggaggccagctggctctagggaaccctgcccctattcctcgtcatgctccaattccacgttatagcacatacctaatgctactattgattgtctcatatgcatcagca

SEQ ID NO: 4607 - RNA, 1680 nt, synthetic construct
  misc_feature 1..1680: note = derived and/or modified CDS sequence (wt) from RVFV(35/74)__JF784387.1__Gn
  source 1..1680: mol_type = other RNA
atggcagggattgcaatgacagtccttccagccttagcagtttttgctttggcacctgttgtttttgctgaagaccctcatctcagaaacagaccagggaaggggcacaactacattgacgggatgactcaggaggacgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccctgcatgaaggagaaactcgtgatgaagacacactgtccaaatgactaccagtcagctcattacctcaacaatgacgggaaaatggcttcagtcaagtgccctcctaaatatgagctcactgaggactgcaatttttgcaggcagatgacaggtgctagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctcaaaagctttgatatctctcagtgccccaagattggaggacatggtagcaagaagtgcactggggacgcagctttttgctctgcttatgagtgcactgctcaatacgccaatgcttattgttcacatgctaatgggtcaggagttgtacagatacaagtatccggggtctggaagaagcctttgtgtgtcgggtatgagagggtggttgtgaagagagaactctctgctaagcccatccagagagttgagccttgcacaacttgtataaccaaatgtgagcctcacggattggttgtccgatcaacaggtttcaagatatcatctgcagttgcttgtgctagcggagtttgcgttacaggatcgcagagcccttctaccgagattacactcaagtatccagggatatcccagtcctctgggggggacataggggttcacatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctggatccactaatgtggattactgttttcatcagatgggtgtataagaagatggttgccagagtagcagacaatatcaatcaggtgaacagggaaataggatggatggaaggaggccagctggctctagggaaccctgcccctattcctcgtcatgctccaattccacgttatagcacatacctaatgctactattgattgtctcatatgcatcagca

SEQ ID NO: 4608 - RNA, 1680 nt, synthetic construct
  misc_feature 1..1680: note = derived and/or modified CDS sequence (wt) from RVFV__M11157.1__Gn
  source 1..1680: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttcagagtgctcatgggaacccctgcatgaaagagaaactcgtgatgaagacacactgtccaaatgactaccagtcagctcattacctcaacaatgacgggaaaatggcttcagtcaagtgccctcctaagtatgggctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcacacaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgtttagtgcatggctgcatagtgtgtgctcatggcctgataaattaccagtgtcacactgctctcagtgcctttgttgttgtgtttgtattcagttctattgcaataatttgtttagctgttctttatagggtgcttaagtgcctgaagattgccccaaggaaagttctgaatccactaatgtggatcacagccttcatcagatggatatataagaagatggttgccagagtggcacacaacattaatcaagtgaacagggaaataggatggatggaaggaggtcagttggttctagggaaccctgcccctattcctcgtcatgccccaatcccacgttatagcacatacctgatgttattattgattgtctcatatgcatcagca

SEQ ID NO: 4609 - RNA, 1680 nt, synthetic construct
  misc_feature 1..1680: note = derived and/or modified CDS sequence (wt) from RVFV(KEN/Bar-035/07)__HM586969.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggagacttcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctgacggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagca

SEQ ID NO: 4610 - RNA, 1680 nt, synthetic construct
  misc_feature 1..1680: note = derived and/or modified CDS sequence (wt) from RVFV(Kenya 56 (IB8))__DQ380190.1__Gn
  source 1..1680: mol_type = other RNA
atggcagggattgcaatgacagtccttccagccttagcagtttttgctttggcacctgttgtttttgctgaagaccctcatctcagaaacagaccagggaaggggcacaactacattgacgggatgactcagggggatgccacatgcaaacctgtgacatatgctggggcttgtagcagttttgatgtcttgctcgaaaagggaaaattccccctcttccagtcgtatgcccatcacagaaccctactagaagcagttcacgacaccatcattgcaaaggctgatccacctagctgtgaccttcagagtgctcatgggaatccttgcatgaaggagaaactcgtgatgaagacacactgtccaaaagactaccagtcagctcattacctcaacaatgacgggaaaatggcttcagtcaagtgccctcctaaatatgagctcactgaggactgcaatttttgcaggcagatgacaggtgccagcttgaagaaggggtcttatcctcttcaggacttattttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtatttaagaactcaaagaaggtttatcttgataagcttgacctcaagactgaggaaaatctgttgccagactcatttgtctgcttcgagcataagggacagtataaaggaacaatggactctggtcagaccaagagggagctaaaaagctttgatatctctcagtgccccaagattggaggacatggtagcaagaagtgcactggggacgcagctttttgctctgcttatgagtgcactgctcaatacgccaatgcttattgttcacatgctaatgggtcaggaattgtacagatacaagtatccggggtctggaagaggcctttgtgtgtagggtatgagagggtggttgtgaagagagaactctctgctaagcccatccagagagttgagccttgcacaacttgtataaccaaatgtgagcctcatggattggttgtccgatcaacaggtttcaagatatcatctgcagttgcttgtgctagcggagtttgcgttacaggatcgcagagcccttctaccgagattacactcaagtatccagggatgtcccagtcctctgggggggacataggggttcatatggcacatgatgatcagtcagttagctccaaaatagtagctcactgccctccccaggatccatgcctagtgcatggctgcatagtgtgtgctcatggcctgataaattaccagtgtcacactgctctcagtgcctttgttgttgtgttcgtatttagctctgtcgcaataatttgtttggccattctttataaagttctcaagtgcctaaagattgccccaaggaaagttctgaatccactaatgtggattactgctttcatcagatgggtgtataagaagatggttgccagagtggcagacaatatcaatcaggtgaacagggaaataggatggatggaaggaggccagccggctctagggaaccctgcccctattcctcgtcatgctccaattccacgttatagcacatacctaatgctactattgattgtctcatatgcatcagca

SEQ ID NO: 4611 - RNA, 1680 nt, synthetic construct
  misc_feature 1..1680: note = derived and/or modified CDS sequence (wt) from RVFV(KEN/Bar-032/07)__HM586968.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggagacttcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgacccacctagctgtgaccttcagagtgctgatggtaataaatgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaaatgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtagtaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgtgggggacataggggttcacatggcacacgatgatcagtcagttagctccaaaatagtagctcactgccctccccaggacccgtgcttagtgcatggctgcatagtgtgtgctcatggcctgataaattaccagtgtcacactgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagca

SEQ ID NO: 4612 - RNA, 1680 nt, synthetic construct
  misc_feature 1..1680: note = derived and/or modified CDS sequence (wt) from RVFV(Beijing-01)__KX611606.1__Gn
  source 1..1680: mol_type = other RNA
atggcagggattgcaatgacagttcttcccgccttagcagtttttgctttggcacctgttgtttttgctgaggaccctcatctcagaaacagaccagggaagggacataactacattgacggggtgactcaggaggatgccacatgcaaacctgtgacatatgctggggcatgtagcagttttgatgttttgctcgaaaagggaaaattccccctcttccagtcatatgctcatcatagaactctactagaggcagttcacgacaccatcattgcaaaggctgatccacctagctgtgatctccagagtgctcatgggaatccctgcatgaaagagaaactcgtgatgaagacacactgtccaaatgactaccagtcagctcattacctcaacaatgacgggaaaatggcttcagtcaagtgccctcctaagtatgagcttactgaggactgcaacttttgtaggcagatgacaggtgctagcttgaagaaggggtcttatcctctccaggacttattttgtcagtcaagtgaggatgatggatcaaaactaaagacaaaaatgaaaggggtctgcgaagtgggggttcaagcactcaaaaagtgtgatggccgactcagcactgcacatgaggttgtgccctttgcagtgtttaagaattcaaagaaggtttatcttgacaagcttgaccttaagactgaagaaaatctgctaccagactcatttgtctgctttgagcataagggacagtataaaggaacaatggactctggtcagactaagagggagctcaaaagctttgatatctctcagtgccccaagattgggggacatggtagcaagaagtgcactggggacgcagcattttgctctgcttatgagtgtactgctcaatatgccaatgcctattgttcacatgctaatgggtctgggattgtacagatacaagtatccggggtctggaagaagcctttatgtgtggggtatgagagagtggttgtgaagagagaactctctgccaagcccatccagagagttgagccttgcacaacttgcataaccaaatgtgagcctcatggattggttgtccgatcaacagggttcaagatatcatctgcagttgcttgtgccagcggagtttgcgtcacaggatcgcagagcccttctactgagatcactctcaagtatccagggatatcccagtcctctgggggggatataggggttcacatggcacatgatgatcagtcagttagctccaaaatagtctttgactgccctccccaggacccgtgcctagtgcatggctgcatagtgtgtgctcatggcttgataaattaccagtgtcacactgctcttagtgcttttgttgttgtgttcgtattcagctctgttgcaataatttgtctggccattctttataaggtgctcaggtgcctaaagattgccccaaagaaagttctgaatccactaatgtggatcactgccttcatcagatgggtgtataagaagatggttgccagagtggcagacaatatcaatcaagtgaacagagaaataggatggatggaaggaggccagttggctctagggaaccctgctcccattcctcgtcatgctccgattccacgttatagcacatacctaatgctactattgattatctcatatgcatcagca

SEQ ID NO: 4613 - RNA, 1680 nt, synthetic construct
  misc_feature 1..1680: note = derived and/or modified CDS sequence (wt) from RVFV(Smithburn)__DQ380193.1__Gn
  source 1..1680: mol_type = other RNA
atggcagggattgcaatgacagtctttccagccttagtagtttttgctttggcacctgttgtttttgctgaagaccctcatctcagaaacagaccagggaagggacacaactacattgacgggatgactcaggaggatgccacatgtaaacctgtgacatatgctggggcatgtagcagttttgatgtcttgctcgaaaagggaaaatttcccctcttccagtcgtatgctcatcatagaactctattagaggcagttcacgacatcatcattgcaaaggctgatccacctagctgtaaccttcagagtgctcatgggaatccctgcatgaaagagaaactcgtaatgaagacatactgtccaaatgactaccagtcagctcattacctcaacaatgacgggaaaatggcttcagtcaagtgccctcctaagcatgagctcactgaggactgcaacttttgtaggcagatgacaggtgctagcttgaaggaggggtcttatcctctccaagacttattttgtcagtcaagtgaggatgatggatcaaaattaaaaacaaaaatgaaaggggtctgcgaagtgggggttcaagtactcaaaaagtgtgatggccaactcagcactgcacatgaagttgtgccctttgcagtgtttaagaactcaaagaaggtttatcttgacaagcttgacctcaagactgaggaaaatctgctaccagactcatttgtctgcttcgagcataagggacagtacaaaggaacaatggactctggtcagattaagagggagctcaaaagctttgatatctctcagtgccccaagattggaggacatggtagcaagaagtgcactggggacgcagcattttgctctgcttatgagtgtactgctcaatacgccaatgcctattgttcacatgctaatgggtcaggaattgtacagatacaagtatccggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatctgcagttgcttgtgctagcggagtttgcgtcacaggatcgcagagcccttctactgagattacactcaagtatccagggatatcccagtcctctgggggagacataggggttcacatggcacatgatgatcagtcagttagctccaaaatagtggcccactgccccccccaggacccgtgcctagtgcatggctgcatagtgtgtgctcatggcttgataaattaccagtgtcacactgctttcagtgcctttgttgttgtgttcgtattcagctctgttgtgataatttgtttggccattctttataaggtgctcaagtgcctaaagattgccccaaggaaagttctgaatccactaatgtggatcactgccttcatcagatgggtgtataagaagatggttgccagagtggcagacaatattaatcaagtaaacagggaaataggatggatggaaggaggccagttggttctagggaaccctgcccctattcctcgtcatgctccaattccacgttatagcacatacctaatgctgctattgattgtctcatatgcatcagca

SEQ ID NO: 4614 - RNA, 1680 nt, synthetic construct
  misc_feature 1..1680: note = derived and/or modified CDS sequence (wt) from RVFV(TAN/Dod-002/07)__HM586971.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggtccaagcactcaaaaagtgtgatggccaactcagcactgcacatgaggttgtgccctttgcagtgtttaaaaactcaaagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtaggaagaagtgcactggggacgcagcattttgctctgcttatgaatgcactgctcagtatgccaatgcctattgttcacatgctaacgggtcagggattgtgcagattcaagtatcaggggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcaggcctggataatctctcagtggcacacggctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagca

SEQ ID NO: 4615 - RNA, 1680 nt, synthetic construct
  misc_feature 1..1680: note = derived and/or modified CDS sequence (wt) from RVFV(KEN/Gar-004/06)__HM586964.1__Gn
  source 1..1680: mol_type = other RNA
atggcagggattgcgatgacagtccttccagccttagcagtttttgctttggcacctgttgtttttgctgaagacccccatctcagaaacagaccagggaaggggcacaactacattgacggaatgactcaggaggatgccacatgcaaacctgtgacatatgctggggcatgtagcagttttgatgtcttgcttgaaaagggaaaatttccccttttccagtcatatgctcatcatagaactctactagaggcagttcacgacaccatcattgcaaaggctgatccacctagctgtgaccttcagagtgctcatgggaatccctgtatgaaagagaaacttgtgatgaagacacattgtccaaatgactaccagtcagctcattacctcaacaatgacgggaaaatggcttcagtcaagtgcccacctaagtatgagctcactgaggactgcaacttttgtagacagatgacaggtgctagcctgaagaaggggtcttatcctctccaagacttattttgtcagtcaagtgaggatgatggatcaaaattgaaaacaaaaatgaaaggggtctgcgaagtgggggttcaagcactcaaaaagtgtgatggccaactcagcactgcacatgaggttgtgccctttgcagtgtttaaaaactcacagaaggtttatcttgataaacttgacctcaagactgaggagaatctgctaccagactcatttgtctgcttcgagcataagggacagtataaaggaacaatggactctggtcagaccaagagggagctcaaaagctttgatatctctcagtgccccaagattggagggcatggtaggaagaagagaactggggacgcagcattttgctctgcttatgaatgcactgctcagtatgccaatgcctattgttcacgtgccaacgggtcagggattgtgcagattcaagtatcaagggtctggaagaagcctttatgtgtagggtatgagagagtggttgtgaagagagaactctctgccaaacccatccagagagttgagccttgcacaacttgtataaccaaatgtgagcctcatggattggttgtccgatcaacagggttcaagatatcatctgcagttgcttgtgctagcggggtttgcgtcacagggtcgcagagtccttctactgagattacactcaagtatccagggatatcccagtcctctgggggggacataggggttcacatggcacacgatgatcagtcagttagctccaaaatagtagctcactgccctccccaggacccgtgcttagtgcatggctgcatagtgtgtgctcatggcctgataaataaccagtcacactctgctctcagtgcctttgttgtcatatttgtattcagttctactgcaataatttgcttagctgttctttatagggtgctcaagtgcttaaagattgccccaaggaaagtcctgaatccactaatgtggattacagccttcatcagatgggtgtataagaagatggttgctagagtggcagacaatattaatcaagtgaacagagaaataggatggatggaaggaggtcagttggctctagggaaccctgcccctattcctcgtcatgccccaatcccacgttatagcacatacctaatgctactattgattgtctcatatgcatcagca

SEQ ID NO: 4616 - RNA, 1521 nt, synthetic construct
  misc_feature 1..1521: note = derived and/or modified CDS sequence (wt) from RVFV(ZH-548)__DQ380206.1__Gc
  source 1..1521: mol_type = other RNA
tgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctca

SEQ ID NO: 4617 - RNA, 1521 nt, synthetic construct
  misc_feature 1..1521: note = derived and/or modified CDS sequence (wt) from RVFV(35/74)__JF784387.1__Gc
  source 1..1521: mol_type = other RNA
tgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagggagggccagagctattggactgggtcctttagccctaaatgtctgagctcaaggagatgccatcttgtcggggaatgtcatgtgaataggtgtctgtcttggagagacaatgaaacctcagcagaattttcatttgttggggaaagcacgaccatgcgggagaacaagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgatggctctgtttcaacaatagacctgggagcatcatctagccgtttcacaaactggggttcagttagcctctcactggacgcagagggcatttcaggctcaaacagcttttccttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaatcttatttcatacaagcccatgatagatcagttggagtgcacaacaaatctgattgatccctttgttgtctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatggatctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttccttcttatatatcttggaagaacaggcctctctaaaatgtggcttgctgccaccaagaaagcctca

SEQ ID NO: 4618 - RNA, 1521 nt, synthetic construct
  misc_feature 1..1521: note = derived and/or modified CDS sequence (wt) from RVFV(200803162)__JF311377.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctca

SEQ ID NO: 4619 - RNA, 1521 nt, synthetic construct
  misc_feature 1..1521: note = derived and/or modified CDS sequence (wt) from RVFV(200803166)__JF311381.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagttggggcagaggcttgtttgatgttgaagggggttaaggaagatcaaaccaagttcttgaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagtctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatgtagttctcccatcagagaatgggacaaaagatcagtgtcagatactgcatttcactgtacctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctca

SEQ ID NO: 4620 - RNA, 1521 nt, synthetic construct
  misc_feature 1..1521: note = derived and/or modified CDS sequence (wt) from RVFV(SA-51 (Van Wyck))__DQ380195.1__Gc
  source 1..1521: mol_type = other RNA
tgctcagaactgattcaggcaagctccagaatcaccacttgctctacagaaggtgtcaacaccaagtgtaggctgtctggcacagcattaatcagggcagggtcagttggggcagaggcttgtttgatgttgaagggggtcaaggaagaccaaaccaagttcttgaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggataatgaaacttcagcagagttttcatttgttggggaaagcacgaccatgcgagaaaataagtgttttgagcagtgtggaggatggggatgtgggtgtttcaatgtgaacccatcttgcttatttgtgcacacgtatctgcagtcagttagaaaagaggcccttagagtttttaactgtatcgattgggtgcataaactcactctggaggtcacagattttgatggctctgtttcaacaatagacttgggagcatcatctagccgtttcacaaactggggttcagttagcctctcactggatgcagagggcatttcaggctcaaatagcttttctttcattgagagcccaggcaaagggtatgcaattgttgatgagccattctcagaaattcctcggcaagggttcttgggggagatcaggtgcaattcagaatcttcagttctgagtgcccacgaatcatgccttagggcaccaaaccttatctcatacaagcccatgatagatcagttggagtgcacaacaaatctgattgatccctttgttgtctttgagaggggttccctgccacagacaaggaatgacaaaacctttgcagcttcaaaaggaaacaggggtgttcaagctttctctaagggctctgtacaagctgatctaactctgatgtttgacaattttgaggtggactttgtgggagcagccgtgtcttgtgatgctgccttcttaaatttgacagggtgctattcttgcaatgcaggggccagggtctgcctgtctatcacatccacaggaactggaaccctctctgcccacaataaggatgggtctctgcatatagttcttccatcagagaatggaacaaaagatcagtgtcagatactacacttcactgttcctgaagtagaggaagagtttatgtactcttgtgatggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttccttcttatatatcttggaagaacaggtctttctaaaatgtggcttgctgctactaagaaggcctca

SEQ ID NO: 4621 - RNA, 1521 nt, synthetic construct
  misc_feature 1..1521: note = derived and/or modified CDS sequence (wt) from RVFV(ZINGA J83 R1)__KU978776.1__Gc
  source 1..1521: mol_type = other RNA
tgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggagaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctggagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgagtcatgccttagggcaccaaaccttatctcatacaagcccatgatagatcaattggagtgcacaacaaatctgattgacccctttgttgtatttgagaggggttctctgccacagacaaggaatgacaaaacctttgctgcttcaaaaggaaatagaggtgttcaagctttctctaagggctctgtgcaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctattggtgagggggactctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcttgtatgttgcattatcaattgggctctttttcctcctcatatatcttggaagaacaggcctctctaaaatgtggcttgctgctactaagaaggcctca

SEQ ID NO: 4622 - RNA, 1521 nt, synthetic construct
  misc_feature 1..1521: note = derived and/or modified CDS sequence (wt) from RVFV(Entebbe)__DQ380191.1__Gc
  source 1..1521: mol_type = other RNA
tgttcagaactaattcaggcaagctccagaatcaccacctgctccacagaaggtgtcaacaccaagtgtaggctgtctggcacagcattaatcagggcagggtcagttggggcagaggcttgtttgatgttaaagggggtcaaggaagaccagaccaagttcttgaagataaaaactgtctcaagtgagctatcgtgtagggagggccagagctattggactgggtcctttagccccaaatgtctgagctcaaggagatgccatcttgtcggagaatgtcatgtgaataggtgtctgtcttggagggacaatgagacttcagcagaattttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtattgattgggtgcataaactcactctagagatcacagactttgatggctctgtttcaacagtagacttgggagcatcatctagccgtttcacaaactggggttcagttagcctctcactggacgcagagggcatttcaggctcaaatagcttctctttcattgagagcccaggcaaagggtatgcaattgttgatgagccattctcagaaattcctcggcaagggttcttgggagagatcaggtgcaattcagaatcttcagtcctgagtgctcatgaatcatgccttagggcaccaaaccttatctcatacaaacccatgatagatcagttggagtgcacaacaaatctgattgatccctttgttgtctttgagaggggttctctgcctcagacaaggaatgacaaaacctttgcagcttcaaaaggaaataggggtgttcaagctttctctaagggctctgtacaagctgatctaactctgatgtttgacaattttgaggtggactttgtgggagcagccgtgtcttgtgatgccgccttcttaaacttgacaggttgctattcctgcaatgcaggggccagagtctgtctgtctatcacatctacaggaactggaactctttctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaggggaccctgatagctattgatccatttgatgataggcgagaagcagggggggaatcaacagttgtgaatccaaaatctggatcttggaacttctttgactggttttctggacttatgagttggtttggagggcctcttaagactatactcctaatttgcctgtatgtagcattatcaattgggctctttttccttcttatatatcttggaagaacaggtctctccaaaatgtggcttgctgccactaagaaagcttca

SEQ ID NO: 4623 - RNA, 1521 nt, synthetic construct
  misc_feature 1..1521: note = derived and/or modified CDS sequence (wt) from RVFV(Sudan 2V-2007)__JQ820490.1__Gc
  source 1..1521: mol_type = other RNA
tgttcagaacttattcaggcaagctccagaatcaccacttgctccacagagggtgtcaacaccaagtgtagactgtctggcacagcattgatcagggcagggtcagttggggcggaggcttgtttgatgttgaagggggtcaaggaagatcaaactaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtaaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggtttttgggggagatcaggtgcaattcagagtcctcagtcctaagtgctcatgaatcatgccttagggcgccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaagacgggtctctgcatatagttctcccatcagagaatgggacaaaagatcagtgtcagatactacattttactgtacctgaagtagaagaggagtttatgtactcttgtgatggagatgagcggcctctgttagtaaaagggaccctgatggctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctca

SEQ ID NO: 4624 - RNA, 1521 nt, synthetic construct
  misc_feature 1..1521: note = derived and/or modified CDS sequence (wt) from RVFV(Sudan 86-2010)__JQ820489.1__Gc
  source 1..1521: mol_type = other RNA
tgttcagaactgattcaggcaagttccagaatcaccacttgctccacagagggtgtcaacaccaagtgtagactgtctggcacagcattgatcagggcagggtcagttggggcggaggcttgtttgatgttgaagggggtcaaggaagatcaaaccaagttcttaaagataaaaactgtctcaagtgagctatcgtgcagggagggccagagctattggactgggtccttcagccccaagtgcctgagctcaaggagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttatctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatctgacaggttgctattcttgcaatgcaggggccagagtttgcctgtctatcacatccacaggaactgggactctctctgcccacaataaggacgggtctctgcatatagttctcccatcagagaatgggacaaaagatcagtgtcagatactacatttcaccgtacctgaagtagaagaggagtttatgtactcttgtgatggagatgagcggcctctgttagtgaaagggaccctgatagctattgacccatttgatgataggcgggaggctgggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctca

SEQ ID NO: 4625 - RNA, 1521 nt, synthetic construct
  misc_feature 1..1521: note = derived and/or modified CDS sequence (wt) from RVFV(Kenya 56 (IB8))__DQ380190.1__Gc
  source 1..1521: mol_type = other RNA
tgttcagaactgattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccaaaccaagtttttgaagataaaaactgtctcaagtgagctatcgtgcagagagggccagagctattggactgggtcctttagccctaaatgtctgagctcaaggaggtgccatcttgtcggggaatgtcatgtgaataggtgtctgtcttggagagacaatgaaacttcagcagaattttcatttgttggggaaagcacgaccatgcgggagaataagtgttttgagcagtgtggaggatggggatgtgggtgtttcaatgtgaacccatcttgcttatttgtgcacacgtatctgcagtcagtcagaaaagaggcccttagagttttcaactgtatcgattgggtgcataaactcactctagagattactgactttgatggctctgtttcaacaatagacctgggagcatcatctagccgtttcacaaactggggttcagttagcctctcactggacgcagagggcatttcaggctcaaacagcttttctttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaaccttatttcatacaagcccatgatagatcagttggagtgcacaacaaatctgattgatccctttgttgcctttgagaggggctctctgccacagacaaggaatgacaaaacctttgcagcttcaaaaggaaataggggtgttcaagctttctctaagggctctgtacaggctgatctaacactgatgtttgacaattttgaggtggactttgtgggagcagccgtgtcttgtgatgccgccttcttaaatttgacaggttgctattcctgcaatgcaggggccagagtctgcctgtctatcacatccacaggaactggaactctctctgcccacaataaagatgggtctctgcatatagttcttccatcagagaatggaacaaaagatcagtgtcagatactacacttcactgtacctgaggtagaggaggagtttatgtactcttgtgatggagatgagcggcctctgttggtgaagggaaccctgatagctattgatccatttgatgataggcgagaagcagggggggaatcaacagttgtgaatccaaaatctggatcttggaatttctttgactggttttctggactcatgagttggtttggagggcctcttaagactatactcctcatttgcctgtatgtagcattatcaattgggctctttttcctccttatatatcttggaagaacaggcctctctaaaatgtggcttgctgccaccaagaaagcctca

SEQ ID NO: 4626 - RNA, 1521 nt, synthetic construct
  misc_feature 1..1521: note = derived and/or modified CDS sequence (wt) from RVFV(ARD-38388)__DQ380187.1__Gc
  source 1..1521: mol_type = other RNA
tgttcagaactgattcaggcaagctccagaataaccacttgctccacagaaggtgtcaacaccaagtgtaggctgtctggcacagcattaatcagggcagggtcagttggggcagaggcttgcttgatgttgaagggggtcaaggaagaccaaacaaagttcttaaagataaaaactgtctcaagtgagctatcgtgcagggaaggccagagctattggactggatcctttagtcccaaatgtctgagctcaaggagatgccatctagtcggggaatgtcatgtgaacaggtgtctgtcttggagggacaatgaaacttcagcagagttttcatttattggggaaagcacgactatgcgagagaataaatgttttgagcagtgtggaggatggggatgtggatgcttcaatgtgaacccatcttgcttgtttgtgcacacgtatctgcagtcagttagaaaagaggcccttagagtttttaactgtatcgattgggtgcataaactcactctagagatcacagactttgatggttctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaatccctcggcaagggttcttgggggagatcaggtgcaattcagaatcttcaatcctgagtgctcatgaatcatgccttcgggcaccaaacctcatctcatacaagcccatgatagaccagttggagtgcacaacaaatctgattgatccctttgttgtctttgagaggggttccctgcctcagacaaggaatgataaaacctttgcagcttcaaaaggaaataggggtgttcaagccttctctaagggctctgtacaagctgatttaactctgatgtttgacaattttgaggtggactttgtgggagcagccgtgtcttgtgatgcagccttcttaaatctgacaggttgttattcttgcaatgcaggggccagagtctgcctgtctatcacatccacaggaactgggactctctctgcccataataaggatgggtctctgcatatagttcttccatcagagaatggaacaaaagatcagtgtcagatactacacttcactgtacctgaggtagaggaggagtttatgtactcttgtgatggggatgagcggcctctgttggtgaaggggaccctgattgctattgatccatttgatgataggcgggaagcaggaggggaatcaacagttgtgaatccaaaatctggatcttggaatttctttgactggttttctggactcatgagttggtttggagggcctcttaagactatactcctcatttgcctgtatgttgcattatcaattgggctctttttccttcttatatatcttggaagaacaggtctctctaaaatgtggcttgctgctactaagaaggcctca

SEQ ID NO: 4627 - RNA, 1521 nt, synthetic construct
  misc_feature 1..1521: note = derived and/or modified CDS sequence (wt) from RVFV(Sudan 28-2010)__JQ820491.1__Gc
  source 1..1521: mol_type = other RNA
tgttcagaactgattcaggcaagctccagaatcaccacttgctctacagagggtgtcaacaccaagtgtagactgtctggcacagcattgatcagggcagggtcagttggggcggaggcttgtttgatgttgaagggggtcaaggaagatcaaaccaagttcttaaagataaaaactgtttcaagtgagctatcgtgcagggagggccagagctattggactgggtcctttagccccaagtgcctgagctcaagaagatgccatcttgtcggagaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgtattatcaattgggctcttcttcctccttatatatcttggaagaacaggcctctctaaaatgtggcttgctgctactaagaaggcctca

SEQ ID NO: 4628 - RNA, 1521 nt, synthetic construct
  misc_feature 1..1521: note = derived and/or modified CDS sequence (wt) from RVFV(200803167)__JF311382.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgtttcgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatgctcctcatttgcctgtatgttgcattatcaattgggctcttcttcctccttatatatcttggaagaacaggcctctctaaaatgtggcttgccgctactaagaaggcctca

SEQ ID NO: 4629 - RNA, 1521 nt, synthetic construct
  misc_feature 1..1521: note = derived and/or modified CDS sequence (wt) from RVFV(73HB1230)__DQ380221.1__Gc
  source 1..1521: mol_type = other RNA
tgttcagaactgattcaggcaagctccagaatcaccacttgctccacagagggtgttaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaaatgtctgagctcaaggagatgccatcttgttggagagtgtcatgtgaataggtgtctgtcttggagggacaatgaaacttcagcagagttttcatttgttggggaaagcacgatcatgcgagagaataagtgttttgagcagtgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacgacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagctgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctgttggtgaaagggaccctgatagctattgatccatttgatgataggcgggaagcagggggggaatcaacagttgtgaatccaaaatctggatcttggaatttctttgactggttttctggactcatgagttggtttggagggcctcttaaaactatactcctcatttgtctgtatgttgcattatcaattgggctctttttcctccttatatatcttggaagaacaggcctctctaaaatgtggcttgctgctactaagaaggcctca

SEQ ID NO: 4630 - RNA, 1521 nt, synthetic construct
  misc_feature 1..1521: note = derived and/or modified CDS sequence (wt) from RVFV(2250/74)__DQ380209.1__Gc
  source 1..1521: mol_type = other RNA
tgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcagtgtggaggatgggggtgtgggtgttttaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagagattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccaaggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctca

SEQ ID NO: 4631 - RNA, 1521 nt, synthetic construct
  misc_feature 1..1521: note = derived and/or modified CDS sequence (wt) from RVFV(SAUDI 200010901)__KU978778.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagttggggcagaggcttgtttgatgttgaagggagtcaaggaagatcaaaccaagttcttaaagataaaaactgtctctagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgttattcctgcaatgcaggggccagagtctgcctgtctatcacatccacaggaactggaactctctctgcccacaataaggacgggtctctgcatatagttctcccatcagagaatgggacaaaagatcagtgtcagatactacatttcactgtgcctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctca

SEQ ID NO: 4632 - RNA, 1521 nt, synthetic construct
  misc_feature 1..1521: note = derived and/or modified CDS sequence (wt) from RVFV(Lunyo)__KU167026.1__Gc
  source 1..1521: mol_type = other RNA
tgttcagaactgattcaggcaagctccagaatcaccacttgctccacagaaggtgtcaacaccaggtgtaggctgtctggcacagcattaatcagggcagggtcagttggggcagaggcttgtttgatgttaaagggggtcaaggaagaccaaaccaagttcttgaagataaaaactgtctcaagtgagctatcgtgcagggagggccagagctattggactggatcctttagccccaaatgtctgagctcaaggagatgccatcttgtcggggaatgtcatgtgaataggtgtctgtcttggagggacaatgaaacttcagcagaattttcatttgttggggaaagcacgactatgcgagagaataaatgttttgagcagtgtggaggatggggatgtgggtgtttcaatgtgaacccatcttgcttatttgtgcacacgtatctgcagtcagttagaaaagaggcccttagagttttcaactgtatcgattgggtgcataaactcactctagagattacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttcagtcctgagtgctcatgaatcatgccttagggcaccaaaccttatttcatacaagcccatgatagatcagttggagtgcacaacaaatttgattgatccctttgttgtctttgagaggggttctctaccacagacaaggaatgacaaaacctttgcagcttcaaaaggaaataggggtgttcaagctttctctaagggctctgtacaagctgacctaactctgatgtttgacaattttgaggtggactttgtgggggcagccgtgtcttgtgatgccgccttcttaaatttgacaggttgctattcctgcaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaggggaccctgatagctattgatccatttgatgataggcgagaagcagggggggaatcaacagttgtgaatccaaaatctggatcttggaatttctttgactggttttctggactcatgagttggtttggagggccccttaagactatactccttatttgcctgtatgtagcattatcaattgggctctttttccttcttatatatcttggaagaacaggtctctctaaaatgtggcttgctgccactaagaaagcctca

SEQ ID NO: 4633 - RNA, 1521 nt, synthetic construct
  misc_feature 1..1521: note = derived and/or modified CDS sequence (wt) from RVFV(25010-24)__KM210509.1__Gc
  source 1..1521: mol_type = other RNA
tgttcagaactgattcaggccagctccagaatcactacttgctccacagaaggtgttaacactaagtgtaggctgtctggcacagcattgatcagggcaggatcagttggagcagaagcttgtctgatgttaaagggggtcaaggatgaccaaaccaagttcctgaagataaaaactgtctcaagtgagctatcgtgcagggagggccagagctattggactgggtccttcagccccaaatgtctgagctcaaggaggtgccatcttgtcggggaatgtcatgtgaataggtgtctgtcttggagggacaatgagacttcagcagaattttcatttgttggggaaagcacgaccatgcgagagaacaagtgttttgagcagtgtggaggatggggatgtgggtgtttcaacgtaaacccatcttgcttgtttgtgcacacgtatctacagtcagtcagaaaagaggcccttagagtttttaactgcattgattgggtgcataaacttactctagagatcacagactttgatggctctgtttcaacaatagacttgggagcttcatctagccgtttcacaaactggggttcagttagcctctcactggacgcagagggcatttcaggctcaaatagcttttctttcattgagagcccaggcaaagggtatgcaattgttgatgagccattctcagaaattcctcggcaaggattcttaggagagatcaggtgcaattcagaatcttcagttctgagtgctcatgaatcatgccttagggcgccaaaccttatctcatacaaaccaatgatagatcagttggagtgcacaacaaatctaattgatccttttgtagtctttgagaggggttccctgccacaaacaaggaatgacaaaacctttgcagcttcaaaagggaataggggtgttcaagctttctctaagggctctgtacaagctgatctaactctgatgtttgacaattttgaggtggacttcgtgggagcagccgtgtcttgtgatgccgccttcttgaatttgacaggttgctattcatgcaatgcaggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaagggaccctgatagctattgatccatttgatgataggcgagaagcagggggggaatcaacagttgtgaatccaaaatctggatcttggaatttctttgactggttttctggactcatgagttggtttggagggcctctcaagactatactcctaatttgcctgtatgtagcattatcaattgggctctttttccttcttatatatcttgggagaacaggtctctctaaaatgtggcttgctgctactaagaaggcctca

SEQ ID NO: 4634 - RNA, 1521 nt, synthetic construct
  misc_feature 1..1521: note = derived and/or modified CDS sequence (wt) from RVFV(2007000253)__JF326192.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagctggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctca

SEQ ID NO: 4635 - RNA, 1521 nt, synthetic construct
  misc_feature 1..1521: note = derived and/or modified CDS sequence (wt) from RVFV(ZC-3349)__DQ380207.1__Gc
  source 1..1521: mol_type = other RNA
tgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttaaggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctatctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaaccatactcctcatttgcctgtatgttgcattatcaattgggctctttttcctccttatatatcttggaagaacaggcctctctaaaatgtggcttgctgccactaagaaggcctca

SEQ ID NO: 4636 - RNA, 1521 nt, synthetic construct
  misc_feature 1..1521: note = derived and/or modified CDS sequence (wt) from RVFV(OS-1)__DQ380186.1__Gc
  source 1..1521: mol_type = other RNA
tgttcagaactgattcaggcaagctctagaataaccacttgctctacagaaggtgtcaacaccaagtgtaggctgtctggcacagcattaatcagggcagggtcagttggggcagaggcttgcttgatgttaaagggagtcaaggaggaccaaacaaagttcttgaagataaaaactgtctcaagtgagctatcgtgcagggaaggccagagctattggactggatcctttagtcccaaatgtctgagctcaaggagatgccatcttgtcggggaatgtcatgtgaataggtgtctgtcttggagggacaatgaaacttcagcagagttttcatttgttggggaaagcacgactatgcgagagaataaatgttttgagcagtgtgggggatggggatgtgggtgcttcaatgtgaacccatcttgcttgtttgtgcacacgtatctgcagtcagttagaaaagaggcccttaaagtttttaactgtatcgattgggtgcataaactcactctagagatcacagactttgatggttctgtttcaacaatagacttgggagcatcatctagccgtttcacaaactggggctcagttagcctctcactggatgcagagggcatttcaggctcaaatagcttttctttcattgagagcccaggcaaagggtatgcaattgttgatgagccattctcagaaatccctcggcaagggttcttgggggagatcaggtgcaattcagaatcttcagtcctgagtgctcatgaatcatgccttcgggcaccaaacctcatctcatacaagcccatgatagaccagttggagtgcacaacaaatctgattgatccctttgttgtctttgagaggggttctctgcctcagacaaggaatgataaaacttttgcagcttcaaaaggaaataggggtgttcaagctttctctaagggctctgtacaagctgatttaactctgatgtttgacaattttgaggtggactttgtgggagcagccgtgtcttgtgatgccgctttcttaaatctgacaggttgttattcttgtaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatcgccattgatccatttgatgacaggcgggaagcagggggagaatcaacagttgtgaatccaaaatctggatcttggaatttctttgactggttttctggactcatgagttggtttggagggcctcttaagactatactcctcatttgcctgtatgttgcattatcaattgggctctttttccttctcatatatcttggaagaacaggtctctctaaaatgtggcttgctgctactaagaaggcctca

SEQ ID NO: 4637 - RNA, 1521 nt, synthetic construct
  misc_feature 1..1521: note = derived and/or modified CDS sequence (wt) from RVFV(KEN/Gar-004/06)__HM586964.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagattacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgaggtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctca

SEQ ID NO: 4638 - RNA, 1521 nt, synthetic construct
  misc_feature 1..1521: note = derived and/or modified CDS sequence (wt) from RVFV(Smithburn)__DQ380193.1__Gc
  source 1..1521: mol_type = other RNA
tgttcagaactaattcaggcaagctccagaatcaccacttgctccacagaaggtgtcaacaccaagtgcaggctgtctggcacagcattaatcagggcagggtcagttggggcagaggcttgtttgatgttaaagggggtcaaggaagaccagaccaagttcttgaagataaaaactgtctcaagtgagctatcatgtagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgaacagtgtggaggatggggatgtgggtgtttcaatgtgaacccatcttgcttatttgtgcacacgtatctgcagtcagttagaaaagaagcccttagagtttttaactgtattgattgggtgcataaactgactctagagattacagactttgatggctctgtttcaacagtagacttgggagcatcatctagccgtttcacaaactggggttcagtcagcctctcactggacgcagagggcatttcaggctcaaatagcttctctttcattgagagcccaggcaaagggtatgcaattgttgatgagccattctcagaaattcctcggcaagggttcttgggagagatcaggtgcaattcagaatcttcagtcctgagtgctcatgaatcatgccttagggcaccaaaccttatctcatacaaacccatgatagatcagttggagtgcacaacaaatctgattgatccctttgttgtctttgagaggggttctctgcctcagacaaggaatgacaaaacctttgcagcttcaaaaggaaataggggtgttcaagctttctctaagggctctgtacaagctgatctaactctgatgtttgacaattttgaggtggactttgtgggagcagccgtgtcttgtgatgccgccttcttaaacttgacaggttgctattcctgcaatgcaggggccagagtctgcctgtctatcacatccacaggaactggaactctttctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatagctattgatccatttgatgataggcgagaagcagggggggaatcaacagttgtgaatccaaaatctggatcttggaatttctttgactggttttctggacttatgagttggtttggagggcctcttaagactatactcctaatttgcctgtatgtagcattatcaattgggctttttttctttcttatatatcttggaagaacaggtctctctaaaatgtggcttgctgccactaagaaagcttca

SEQ ID NO: 4639 - RNA, 1521 nt, synthetic construct
  misc_feature 1..1521: note = derived and/or modified CDS sequence (wt) from RVFV(2008/00101)__HE687306.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggcattctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactacactcctcatttgcctgtatgttgcattatcaattgggctcttcttcctccttatatatcttggaagaacaggcctctctaaaatgtggcttgccgctactaagaaggcctca

SEQ ID NO: 4640 - RNA, 1521 nt, synthetic construct
  misc_feature 1..1521: note = derived and/or modified CDS sequence (wt) from RVFV(2007001292)__EU574046.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactggatcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatctctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctca

SEQ ID NO: 4641 - RNA, 1521 nt, synthetic construct
  misc_feature 1..1521: note = derived and/or modified CDS sequence (wt) from RVFV(2007002445)__EU574037.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctatacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctca

SEQ ID NO: 4642 - RNA, 1521 nt, synthetic construct
  misc_feature 1..1521: note = derived and/or modified CDS sequence (wt) from RVFV(Ken 199800523)__KU978777.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgtctgagctcaaggagatgccatcttgtcggggaatgtcatgtgaataggtgtctgtcttggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagaaattcctcggcaagggttcttgggggagatcaggtgcaattcagagtcctcagtcctgaatgctcatgaatcatgccttagggcaccaaaccttatctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgttattcctgcaatgcaggggccagagtctgcctgtctatcacatccacaggaactggaactctctctgcccacaataaggaggggtctctgcatatagttctcccatcagagaatgggacaaaagatcagtgtcagatactacatttcactgtgcctgaagtagaagaggagtttatgtactcttgtgatggagatgagcggcctctgttagtgaaagggaccctgatagctattgacccatttgatgataggcgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctca

SEQ ID NO: 4643 - RNA, 1521 nt, synthetic construct
  misc_feature 1..1521: note = derived and/or modified CDS sequence (wt) from RVFV(clone 13)__DQ380213.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagttggggcagaggcttgtctgatgttgaagggggtcaaggacgatcaaaccaagttcttaaagataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactaacactagagatcacagactttgatggctctgtttcaacaatagacctaggagcatcatctagccgtttcacaaactggggttcagtcagcctctcactggacgcagagggcatttcaggctcaaatagcttttctttcattgagagcccaggcaaagggtatgcaattgttgatgagccattctcagaaattcctcggcaagggttcctgggggagatcaggtgcaattcagagtcctcagtcctgagtgctcatgaatcatgccttagggcaccaaaccttatctcatacaagcccatgatagaccaattggagtgcacaacgaatctgattgatccatttgttgtctttgagaggggttctctgccacagacaaggaatgaaaaaacctttgcagcttcaaaaggaaatagaggtgtccaagccttctctaagggctctgtacaagctgatctaactctgatgtttgacaattttgaggtggattttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcaatgccagatactacacttcactgtacctgaggtagaggaggagtttatgtactcttgtgacggagatgagcggcctctgttggtgaaggggaccctgatagctattgatccatttgatgataggcgggaagcagggggggaatcaacagttgtgaatccaaaatctggatcttggaatttctttgactggttttctggactcatgagttggtttggagggcctcttaaaactatactccttatttgcctgtatgttgcattatcaattgggctctttttcctcctcatatatcttggaagaacaggcctctctaaaatgtggcttgctgctactaagaaggcctca

SEQ ID NO: 4644 - RNA, 1521 nt, synthetic construct
  misc_feature 1..1521: note = derived and/or modified CDS sequence (wt) from RVFV(2373/74)__DQ380194.1__Gc
  source 1..1521: mol_type = other RNA
tgttcagaactgattcaggcaagctccagaatcaccacctgctccacagaaggtgtcaacaccaagtgtaggctgtctggcacagcattaatcagggcagggtcagttggggcagaggcttgtttgatgttaaagggggtcaaagaagaccaaaccaagttcttgaagataaaaactgtctcaagtgagctatcgtgcagggaaggccagagctattggactgggtcctttagccccaaatgcctgagctcaaggaggtgccatcttgtcggggaatgtcatgtgaataggtgtctgtcttggagggacaatgaaacttctgcagaattttcatttgttggggaaagcacgaccatgcgagagaataagtgttttgagcagtgtggaggatggggatgtgggtgtttcaatgtgaatccatcttgcttatttgtgcacacgtatctgcagtcggttagaaaagaggcccttagagttttcaactgtattgattgggtgcataaactcactctagagatcacagactttgatggctctgtttcaacattagacttgggagcatcatctagccgtttcacaaactggggttcggttagcctctcactggatgcagagggcatttcaggctcaaatagcttttctttcattgagagcccaggcaaagggtatgcaattgttgatgagccattctcagaaattcctcggcaagggttcttgggagagatcaggtgcaattcagaatcttcagtcctgagtgctcatgaatcatgccttagggcaccaaaccttatctcatacaagcctatgatagatcagttggagtgcacaacaaatctgattgatccctttgttgtctttgagaggggttctctgccacagacaaggaatgaaaaaacctttgcagcttcaaaaggaaataggggtgttcaagctttctccaagggctctgtacaagctgatcttactctgatgtttgacaattttgaggtggactttgtgggagcagccgtgtcttgtgatgccgccttcttaaatttaacaggttgctattcctgcaatgcaggagccagagtctgcttgtctatcacatccacaggaactggaactctctctgcccacaataaggatgggtctctgcacatagttcttccatcagagaatggaacaaaagatcagtgtcagatactacacttcactgtacctgaggtggaggaggagtttatgtactcttgtgatggagatgagcggcctctattggtgaaggggaccctgatagctattgatccatttgatgataggcgagaagcaggaggggaatcaacagttgtgaatccaaaatctggttcttggaatttctttgactggttttctggacttatgagttggtttggagggcctcttaagaccatactcctaatttgcctgtatgtggcattatcaattgggctctttttcctccttatatatcttggaagaacaggtctctctaaaatgtggcttgctgccactaagaaagcctca

SEQ ID NO: 4645 - RNA, 1521 nt, synthetic construct
  misc_feature 1..1521: note = derived and/or modified CDS sequence (wt) from RVFV(OS-8)__DQ380185.1__Gc
  source 1..1521: mol_type = other RNA
tgttcagaactgattcaggcaagctctagaataaccacttgctccacagaaggtgtcaacaccaagtgtaggctgtctggcacagcattaatcagggcagggtcagttggggcagaggcttgcttgatgttaaagggagtcaaggaggaccaaacaaagttcttgaggataaaaactgtctcaagtgagctatcgtgcagggaaggccagagctattggactggatcctttagtcccaaatgtctgagctcaaggagatgccatcttgtcggggaatgtcatgtgaataggtgtctgtcttggagggacaatgaaacttcagcagagttttcatttgttggggaaagcacgactatgcgagagaataaatgttttgagcagtgtgggggatggggatgtgggtgcttcaatgtgaacccatcttgcttgtttgtgcacacgtatctgcagtcagttagaaaagaggcccttagagtttttaactgtatcgattgggtgcataaactcactctagagatcacagactttgatggttctgtttcaacaatagacttgggagcatcatctagccgtttcacaaactggggctcagttagcctctcactggatgcagagggcatttcaggctcaaatagcttttctttcattgagagcccaggcaaagggtatgcaattgttgatgagccattctcagaaatccctcggcaagggttcttgggggagatcaggtgcaattcagaatcttcagtcctgagtgctcatgaatcatgccttcgggcaccaaacctcatctcatacaagcccatgatagaccagttggagtgcacaacaaatctgattgatccctttgttgtctttgagaggggttctctgcctcagacaaggaatgataaaacttttgcagcttcaaaaggaaataggggtgttcaagctttctctaagggctctgtacaagctgatttaactctgatgtttgacaattttgaggtggactttgtgggagcagccgtgtcttgtgatgccgctttcttaaatctgtcaggttgttattcttgtaatgcaggggccagagtctgcctgtctatcacatccacaggaactggaactctctctgcccacaataaggatgggtctctgcatatagttcttccatcagagaatggaacaaaagatcagtgtcagatactacacttcactgtacctgaggtagaggaggagtttatgtactcttgtgatggagatgagcggcctctgttggtgaaggggaccctgatcgccattgatccatttgatgacaggcgggaagcagggggagaatcaacagttgtgaatccaaaatctggatcttggaatttctttgactggttttctggactcatgagttggtttggagggcctcttaagactatactcctcatttgcctgtatgttgcattatcaattgggctctttttccttctcatatatcttggaagaacaggtctctctaaaatgtggcttgctgctactaagaaggcctca

SEQ ID NO: 4646 - RNA, 1521 nt, synthetic construct
  misc_feature 1..1521: note = derived and/or modified CDS sequence (wt) from RVFV(KEN/Bar-035/07)__HM586969.1__Gc
  source 1..1521: mol_type = other RNA
tgttcagaactgattcaggcaagctccagaatcaccacttgctccacagagggtgtcaacaccaagtgtagactgtctggcacagcattgatcagggcacggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggataatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaacgcaggggccagagtctgcctgtccatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctca

SEQ ID NO: 4647 - RNA, 1521 nt, synthetic construct
  misc_feature 1..1521: note = derived and/or modified CDS sequence (wt) from RVFV(MgH824)__DQ380210.1__Gc
  source 1..1521: mol_type = other RNA
tgttcagaactgattcaggcaagctccagaatcaccacttgctctacagagggtgttgacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacaaccatgcgagagaataagtgttttgagcagtgtggaggatgggggtgtgggtgtttcaatgtgaacccatcttgcttatttgtgcacacgtatctgcagtcagttagaaaagaggcccttagagtttttaactgtatcgactgggtacataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattcccagagattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgacccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacatttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaaggacaggcctctctaaaatgtggcttgctgccactaagaaggcctca

SEQ ID NO: 4648 - RNA, 1521 nt, synthetic construct
  misc_feature 1..1521: note = derived and/or modified CDS sequence (wt) from RVFV(200803169)__JF311384.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagttggggcagaggcttgtttgatgttgaagggggtcaaggtagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagattcctcggcaagggttcttgggggaggtcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctca

SEQ ID NO: 4649 - RNA, 1521 nt, synthetic construct
  misc_feature 1..1521: note = derived and/or modified CDS sequence (wt) from RVFV(2007001811)__EU574040.1__Gc
  source 1..1521: mol_type = other RNA
tgttcagaactgattcaggcaagctccagaatcaccacttgctccacagagggtgtcaacaccaagtgtagactgtctggcacagcattgatcagggcagggtcagttggggcggaagcttgtttgatgttgaagggggtcaaggaagatcaaaccaagttcttaatgataaaaactgtctcaagtgagctatcgtgcagggagggccagagctattggactgggtcctttagccccaagtgcctgagctcaagaagatgccatcttgtcggggaatgtcatgtgaataggtgtctgtcctggagggacaatgaaacttcagcagagttttcatttgttggggaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagtttttcttttattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcgtacaagcccatgatagatcaattggagtgcactacaaatctgattgatccctttgttgtctttgagaggggttctctgccacagacaaggaatgaaaaaacctttgcagcttcaaaaggaaatagaggtgttcaggctttctctaagggctctgtacaagctgatctgactctgatgtttgataattttgaggtggactttgtgggagcagccgtgtcttgtgatgccgccttcttgaatttgacaggttgctattcttgcaatgcaggggccagagtctgcctgtctatcacatccacaggaactgggactctctctgcccacaataaggacgggtctctgcatatagttctcccatcagagaatgggacaaaagatcagtgtcagatactacatttcactgtacctgaagtagaagaggagtttatgtactcttgtgatggagatgagcggcctctgttagtgaaagggaccctgatagctattgacccatttgatgataggcgggaggcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgctgctactaagaaggcctca

SEQ ID NO: 4650 - RNA, 1521 nt, synthetic construct
  misc_feature 1..1521: note = derived and/or modified CDS sequence (wt) from RVFV(Kenya 57 (Rintoul))__DQ380192.1__Gc
  source 1..1521: mol_type = other RNA
tgttcagaactaattcaggcaagctccagaatcaccacttgctccacagaaggtgtcaacaccaagtgtaggctgtctggcacagcattaatcagggcagggtcagttggggcagaggcttgtttgatgttaaagggggtcaaggaagaccagaccaagttcttgaagataaaaactgtctcaagtgagctatcgtgtagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtattgattgggtgcataaactcactctagagatcacagactttgatggctctgtttcaacagtagacttgggagcatcatctagccgtttcacaaactggggttcagttagcctctcactggacgcagagggcatttcaggctcaaatagcttctctttcattgagagcccaggcaaagggtatgcaattgttgatgagccattctcagaaatttctcggcaagggttcttgggagagatcaggtgcaattcagaatcttcagtcctgagtgctcatgaatcatgccttagggcaccaaaccttatctcatacaaacccatgatagatcagttggagtgcacaacaaatctgattgatccctttgttgtctttgagaggggttctctgcctcagacaaggaatgacaaaacctttgcagcttcaaaaggaaataggggtgttcaagctttctctaagggctctgtacaagctgatctaactctgatgtttgacaattttgaggtggactttgtgggagcagccgtgtcttgtgatgccgccttcttaaacttgacaggttgctattcctgcaatgcaggggccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagtttatgtactcttgtgatggagatgagcggcctctgttggtgaaggggaccctgatagctattgatccatttgatgataggcgagaagcagggggggaatcaacagttgtgaatccaaaatctggatcttggaatttctttgactggttttctggacttatgagttggtttggagggcctcttaagactatactcctaatttgcctgtatgtagcattatcaattgggctctttttccttcttatatatcttggaagaacaggtctctccaaaatgtggcttgctgccactaagaaagcttca

SEQ ID NO: 4651 - RNA, 1521 nt, synthetic construct
  misc_feature 1..1521: note = derived and/or modified CDS sequence (wt) from RVFV(Beijing-01)__KX611606.1__Gc
  source 1..1521: mol_type = other RNA
tgttcagaactgattcaggcaagctccagaatcaccacttgctccacagaaggtgtcaacaccaagtgtaggctgtctggcacagcattaatcagggcagggtcagttggggcagaggcttgtttgatgtttgagggggtcaaggaagaccagaccaagttcttaaagataaaaactgtctcaagtgagctatcgtgcagggagggccagagctattggactgggtcctttagccccaaatgtctgagctcaaggagatgccatcttgtcggagaatgtcatgtgaataggtgtctgtcttggagggacaatgaaacttcagcagaattttcatttgttggggaaagcacgaccatgcgagagaataagtgttttgagcagtgtggaggatggggatgtggatgtttcaatgtgaacccatcttgcttatttgtgcacacgtatctgcaatcagttagaaaagaggctcttagagtttttaactgtattgattgggtgcataaactcactctagagatcacagactttgatggctctgtttcaacaatagacttgggagcatcatctagccgtttcacaaactggggctcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagaatcttctgtcctgagtgctcatgagtcatgccttagggcaccaaaccttatctcatacaaacccatgatagatcagttggagtgcacaacaaatctgattgatccctttgttgtctttgagaggggatctctgccacagacaaggaatgacaaaacctttgcagcttcaaaaggaaataggggtgttcaagctttctctaaaggctctgtacaggctgatctaactctgatgtttgacaattttgaggtggactttgtgggagcagccgtgtcttgtgatgccgccttcttaaatttgacaggttgctattcctgcaatgctggagccagagtctgcctgtctatcacatccacaggaactggaactctttctgcccacaataaggatgggtctctgcatatagttcttccatcagagaatggaacaaaagatcagtgtcagatactacacttcactgtacctgaggtggaggaggagttcatgtactcttgtgatggagatgagcgacctttgttggtgaaggggaccctaatagctattgatccatttgatgataggcgagaagcagggggagaatcaacagttgtgaatccaaaatctggatcttggaacttctttgactggttttctggacttatgagttggtttggaggacctcttaagactatactcctaatttgcctgtatgtagcattatcaattgggctctttttccttcttatatatcttggaagaacaggtctctctaaaatgtggcttgctgccactaagaaagcctca

SEQ ID NO: 4652 - RNA, 1521 nt, synthetic construct
  misc_feature 1..1521: note = derived and/or modified CDS sequence (wt) from RVFV(ANK-6087)__DQ380216.1__Gc
  source 1..1521: mol_type = other RNA
tgttcagaactgattcaggcaagctccagaatcactacttgctccacagagggtgtcaacaccaagtgtagactgtctggcacagcattgatcagggcagggtcagttggggcagaggcttgtttgatgttgaagggggtcaaggaagatcaaaccaagttcttaaaaataaaaactgtctcaagtgagctatcgtgcagggagggccagagctattggactgggtcctttagccccaaatgtctgagctcaaggagatgccatcttgtcggggaatgtcatgtgaataggtgtctgtcttggagggacaatgaaacttcagcagagttttcatttgttggagaaagcacgaccatgcgagagaataagtgttttgagcagtgtggaggatggggatgtgggtgtttcaatgtgaacccatcttgcttatttgtgcacacgtatctgcagtcagttagaaaagaggcccttagagtttttaactgtatcgactgggtgcataaactcactctggagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgagtcatgccttagggcaccaaaccttatctcatacaagcccatgatagatcaattggagtgctcaacaaatctgattgacccctttgttgtatttaagaggggttctctgccacagacaaggaatgacaaaacctttgctgcttcaaaaggaaatagaggtgttcaagctttctctaagggctctgtgcaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggaactctctctgcccacaataaggatgggtctctgcatatagttcttccatcagagaatggaacaaaagatcagtgtcagatactacacttcactgtacctgaagtagaggaggagtttatgtactcttgtgatggagatgagcggcctctattggtgagggggactctgatagctattgatccatttgatgataggcgggaagcagggggggaatcaacagttgtgaatccaaaatctggatcttggaatttctttgactggttttctggactcatgagttggtttggagggcctcttaaaactatactcctcatttgcttgtatgttgcattatcaattgggctctttttcctcctcatatatcttggaagaacaggcctctctaaaatgtggcttgctgctactaagaaggcctca

SEQ ID NO: 4653 - RNA, 1521 nt, synthetic construct
  misc_feature 1..1521: note = derived and/or modified CDS sequence (wt) from RVFV(MP12)__Z30318.1__Gc
  source 1..1521: mol_type = other RNA
tgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagttaaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaggaacaggcctctctaaaatgtggcttgctgccactaagaaggcctca

SEQ ID NO: 4654 - RNA, 1521 nt, synthetic construct
  misc_feature 1..1521: note = derived and/or modified CDS sequence (wt) from RVFV(KEN/Bar-032/07)__HM586968.1__Gc
  source 1..1521: mol_type = other RNA
tgttcagaactgattcaggcaagctccagaatcaccacttgctccacagagggtgtcaacaccaagtgtagactgtctcacacagcattgatcagggcagggtcagttggggcagaggcttgtttgatgttgaagggggtcaaggaagatcaaaccaagttcttaaagataaaaactgtctcaagtgagctatcgtgcagggagggccagagctattggactgggtcctttagccccaagtgcctgagctcaaggagatgccatcttgtcggggaatgtcatgtgaataggtgtctgtcttggagggacaatgaaacttcagcagagttttcatttgttggagaaagcacaaccatgcgagagaataagtgttttgagcagtgtggaggatgggggtgtggatgtttcaatgtgaacccttcttgcttatttgtgcacacgtatctgcagtcagttagaaaagaggcccttagagtttttaactgtatcgactgggtgcataaactcactctagagatcacagactttgatggctctgtttcaacaatagacttaggagcatcatctagccgtttcacaaactggggttcagttagcctctcactggacgcagagggcatttcaggctcaaatagcttttcttttattgagagcccaggcaaagggtatgcaattgttgatgagccattctcagagatccctcggcaagggttcttgggggagatcaggtgcaattcagagtcctcagtcctgagtgctcatgaatcatgccttagggcaccaaaccttgtctcgtacaagcccatgatagatcaattggagtgcactacaaatctgattgatccctttgttgtctttgagaggggttctctgccacagacaaggaatgacaaaacctttgcagcttcaaaaggaaatagaggtgttcaggctttctctaagggctctgtacaagctgatctgactctgaggtttgataattttgaggtggactttgtgggagcagccgtgtcttgtgatgccgccttcttgaatttgacaggttgctattcttgcaatgcaggggccagagtctgcctgtctatcacatccacaggaactggaactctctctgcccacaataaggacgggtctctgcatatagttctcccatcagagaacgggacaaaagatcagtgtcagatactacattttactgtacctgaagtagaagaggagttcatgtactcttgtgatggagatgagcggcctctgttagtgaaagggaccctgatagctattgacccatttgatgatagacgggaagcagggggggaatcaacagttgtgaatccaaaatctggatcttggaatttctttgactggttttctggactcatgagttggtttggagggccgcttaaaactatactcctcatttgcctgtatgttgcattatcaattgggctcttcttcctccttatatatcttggaagaacaggcctctctaaaatgtggcttgccgctactaagaaggcctca

SEQ ID NO: 4655 - RNA, 4020 nt, synthetic construct
  misc_feature 1..4020: note = derived and/or modified CDS sequence (wt) from SFNV(Toscana)__NC_006320.1__GP
  source 1..4020: mol_type = other RNA
atgtttattgcaaagttgttattaatttcctgtttagtgcagcaggcctatctgaaatacactattatttcagaaatagggaacggcactagaacttctttttgttatagctcaaggaccagcttggggagcctcctggaagcttgggacaacataactgagtctattggtctgacatctggcacttgtaaagtgggatcactggaaaacagggattgcaaaagagacatcatgtcaaattatgttgcagaagtgcattccaacttacatggcctaggagctatgatgcacaactatggtgatgacaagagggttgaggtcctcaatgatgtcatcccagatgagctcaatccaggacgccacaactgcagtgacctggaccggaaaccattttggacagagtttattaatgtggcaaagccagcaaacaaaatagctcctatatcagtgatcccaccaccaattgtgaagcccataccaattgcagaatcaactatcaagaaaaccatcccatttgataaactcctatctgaagcagaaaaggagttgaaccaaacaaaaatcagattggaaaccgaaagaaggtctaatgcggaagaggctgcaagagaaagggccaggatgagagaaattgaagacaagctgagaaagaattgggagctagaacgggagagaaaagatgcagtggcagacgacctggcaaaagaaatagcgagaagaagagagatagagagaaaagctcatgaattagataagatgctcaagaagaaggagcgtgaagatcaggtggcaatagaaagggtgagtgaggatatgagaaaccatgtgcgtagaccaaatacaaccatagcccctgctcccacgatcattaccaccctgctcatggccagtgcggtaatggcaggacctttggagaacagggaaacaaaccacttactaaacaggccagggaatggagcttataccctaagtgactttgctgagtccacctgcacgctagcttatggctcaaagtgcaaatcctgggagcaccaattggatgagctgtcttttcccttcttccactctaaccttgacaagtacagcatgctagaggctgcaacagagacaataccgatactcaacaagagctcagctgtctgcacaatttccccatccacgcattcatcaaatgcatgtggcagggaagctagcctcataaagaagaaatgtggaaacaatatgtctgctttcttctatgttaacctagccggccagataactgttgtcaagtgtgatacaaaccatgttttgtctaacgactgtgggaattgtatctcaaaaaccttgagcggtcagaagatttatactccagttcaggatatgttctgtcagagaggctggacggagtccatcccaagcacaaggtactcaaaagacctctgttctattggcttgcacactgtgaaggaatgcaagactggtaccaccaactttgagagagtaggtttcattgtcgtgaagagtcgaaagatgtacatagagcagatgaagatgagatcaagacaagaattcagcgaagaccagttcttatgctacaaatcagagagcagttctggctcttctgtaaaattaaagaaggtcaaggttgagtcatgcaaaggtgttacaacatcatcagcctctaagtgctctggggatgaatatttctgcagcaggtacccatgtgaaactgcaaatgttgaagctcattgcattttacgaaggcatagtgcagttatagaagtgaatgtcaatggcgtgtgggttgtgccgagatgcattggttatgaagaggttcttgttagaaggacttcactcaaaatggaagatacatctagtagagaatgtgatacctgcttatgggaatgcggaaaaaataaactaattgtcaaaactcatggccccaaaatagtttatgcaacagcatgtagccatgggtcttgcaagagtgtgatgcaaaagccagcgaccttcgtgtacctaccgtacccaggaaacagcgagattgttggaggtgatataggggtccacatgacagaggaatcatcaccttcaaacatacacatggtggcacactgccctgcgaaggattcctgtgaggttagcagctgcctattctgtgtgcacggactgcttaattaccagtgccacaccttgttctctgcactactaatatccactactgtgatgtccattcttacattgctacttcttcttgtgaagggggctaaagatcttgtcaagaaattattctactggctaattacacccctgtgctggctatcagtgttctgtggctggatgatcaaaagctggaaaaagaaagtgggctcagctatttctagaaccaatgacaccattggttggcgtgacaatagacgatatgggcgagacgttgagagagcacagtacacaggaggagctccaggggctaaatattcattttatggagtgatgatccttggcctattaggtaatgtgcatagttgctctgagagtgtcatagccgactccaaagtcatgcaatgcacaacttcgggaagttctaccctctgcaaggctagtgggactgtgattatgaagctagggcctataggctcagagtcctgcctgattttgaagggtcttaaggacaatgaaaagcaattcatctcaatcaagacaatatcaagtgaactcacatgccgagagggagagtccttctggaccactctatatactcctgtctgtctaagttcgcgaaggtgccacctaatgggagaatgttgctccgaccgctgcctcaaatggaaaaccaatgaaacatctgcagaattcactgggaaggcacatggagaagttatgcatgagaatagatgctttgagcagagcggtggaataggctatggatgctttaatgtgaacccttcttgtctctacgtccattcaattctcaaatctgtctacaagaatggattcaagatctttagatgtgtggcatggaaccacaggattagacttgaagttactacccactcccggaaattcccaatggttttgatggctatgagcacacaacccactgactggggttctattgggttaatcctagattcagaagggataacagggactaacgcgtattccttcatgaagcacgggtcaggaagcttggccattatagatgacccatattccccagagcctcgtaaaggctttttaggagaagtgcgatgtccaacagaagagacagctattcgggcgtcaccctcatgtaagatggctcctaacttgattgagtaccagcctgagatggacactgcagagtgcactacaaacatgatagatcccatggccatattcaatcgagggtccttgccacaagttcgggatggaatgacattcacacaatcaattgagaagaacacagttcaagcactgacaacaggggaggttagagcttccatacgccttacattggacgactatgatgtggtgtatcacaatagccagtccgactgctcagctacatttaagaatctcaccggctgttattcatgtgatgagggttcaagaatgtgctaccaggtgaaggcagaaggagaaactatctttcactttgtcaatgaggatgaatctatcaatgttattaacaaggtgagcccagacgtaagtgactactgcactgttctccacttctcaagacctgtcatctctattgaagggaggtatgactgcgggcttagcaaaagtccaatggtaataaaaggtactctaattgctactgccccgcatgatgacaggaagcatgaaggaggttcctcattggttgtcaaccccaaaggcggcacagttgacttcttcgggtgggtgtctggactaacctcatggctaggtgggcctctgaaaaccttcttgaccatccttggattcctagctctgggcctacttttagtagtgataatcatcaccattgctcgcactggggtcgaacaggccctaaaaaagaaaaacaagtaa

SEQ ID NO: 4656 - RNA, 3972 nt, synthetic construct
  misc_feature 1..3972: note = derived and/or modified CDS sequence (wt) from SFNV__HM566171.1__GP
  source 1..3972: mol_type = other RNA
atgttgaatacaaaatctataattttaataacctgtctagtgcagcaggtccatctgaaatacacgattatttcagaggtgactaagggtgctagggaggtgagctgctatagctcaacaaccagattagaccagctcttggaggcttgggagaataagagtgccctaatgggacttagaaaaggcaattgcaaacttggagctatggagcaggtggattgtaaccttgatctcatgtcaaactacgtctctaatgtctatgataatccacacggtttaggagcaatgatgtacaatgataagaggattgaggttctaaatgaccagattcctgattctatgatccctggaggacacaattgtagtctgctagagagaaagccattctgggctgatctcataccatcaaaaaaggagaatcccaggccatctctgatttcccttgttccaactccaagaagtgatttcaaaaggaaattcgaagaagctgaagaagaaatgaagaaaataaggaaagaattacaagatgagcgtcaggcgcaattaagtgttattgaagaaggcaggaaaaggatgagggacttagaggacaaacttatgaggcagtggaatgaagaaaagcagaagaagggactgcttgaggaaactttggagaagaaaaggcaactgaaaaacaaggctcttcttgatgcacataatctagacaagcagttgaaggaaaaggacagagaatttaagacagccatggaagagcatcagaatgagagacatagaatcaacagtaatatgatcagacctcctatcaccactcccgcagctgtgatcttgacttctcttttatctgccagtgtggttctaggcttcgaattggaaaataggaacactaatcatgcactaaacagacctgggaatggtggttactctattagtgataacaatctgatagaggctaaatgcatgatcacctatggcaacaagtgtccctcctgggaaatgcagttagatcctgtgtcataccccttcttctcttccaattttgagaagtacagtctgctagagtctatttcagaaacctcaccgataatagggaagttctcagaagtctgtgttctctcaaacttacctggagctcagaaaacatgtgccaaagaagcaagcttaatcaagaagcaatgttctgatgacatgagagcctacttctacattaactctttagggaaacttgcaattgtcacatgtccagagaataatgttttgtcacaagactgcaatttctgtctacgaaaagccaaaggagagcagtatgtttacaaacccattcaagatggcttttgtcagaatggaggtgtttcttctgttcctagcattagatattcaaaagatatctgctccataggaccaacaaaggttaaaaattgtcacaaaggcacttctaggtacgaaaggacagcattcatatccactggagacaaaaaagtatatttggaggaaattaaaataagatctaggcaagagtatgagcctgatcagttcttatgctacaaggtaaaggacagctcttcatcgcctcttgcctacgagaaggtccaagtgtccaaatgtaaaggcattgaaacaaacagccctaagaaatgcacaggagatgaatacttctgcagcaagtacccttgtgagtcaaccagccctgaggcaaactgtttcctcagaaagcacagtgcaatactagaggtcaacatcggggggatgtggattaagccaaaatgtattggttatgagatggccctagttaagagggttggtctcaggtctgaagatgtctcatcaaaggagtgtgccacttgcttatgggagtgctccagtggttacataagcatcaccacacatgggcctaagatttcttatgcaactgcatgtagtcatggatcttgcaagagtattgttcaaaacccatcaacatccattagaattagttatccaggaaacagtgaaattgtcgggggtgacatagggatccacttaactgaggactcatctcctatcaacctccatctgaagatccactgttcacctaaggattcttgtgaagtgagtgattgcattttttgcgttcatgggttgctgaattatcaatgtcattccgtggcttctgctctccttttgtccactatcacagcatctcttattgtgttaatgatttacatgctttctaaaactaagtttgtaatgaaaaagctcataccaattatgctcactccgctctgctggtgttttgtactgctagcttggttaactaagtcttggaaagggaaaatgaggaatgcaattcagtcagctaactccacaattgggtggacagaacgtgaagaaaggattgttgcggaaagaccaaggagcaggaataccgtaaggtattctttctatggggttgttatactagccatgttagaatctgcctttggctgctctgaaagcctcattgcagagtcaaaagtaatgcaatgcaatattgcaaatgggaaaacaagctgtagagcctctgggacaattattatgaaattagggccgataggatcagaagcttgtctgattctcaagggacttagggatagtgacaagcagtacatatctgtgaaaactgaatctagtgagctgatctgcagagaaggagagtcattctggacctccttgtatactccagtttgcttaagctcaaggaggtgtcatttaatgggagagtgtacaggagacttgtgcttaaagtggaagtcaaacaaaacttctttagagtttgctggcaagacacgtagtgatgtcataaatgaaaacaagtgttttgagcagagtggtgggctaggatatgggtgcttcaatgtcaacccttcatgtctctatactcatgcttatttgaagtcagtttacaggaatggttttagagtgttcaagtgtgcttcttggactcatagagttaagttaaccattaccacgcactctagaacattccctatgaccctagcagcaatgagcactcaacccacagactggggctcaattggtctaattctcgactcagaggggatctcagggacaaattccttttccttcatgaagcatggtctagggagcttcgctataatagatgagccctattcaatggaacccaggaaggggttcattggagaagtcaggtgtccaacagaagaagcagctataaaagcctctactctgtgtaagacagctccccagttaatagaataccaacctgaaatggacagtgccgaatgcaccacaaatatgattgatccaatgagcgtattcaacagaggctcccttccccaggttagagaaggaatgacttttactcagtctatggagaagaataccgttcaggccatgaccacaggggaagttcatgctagcattaggatagttctcgacgactatgaggttgaatatctttcaagtcaggttgattgtgatgctacattcaaaaatttgactggttgctattcatgcgatgagggtgcaagagtgtgtatgcagattatagcacatggggatactatattccactttagaaatccagatgtgagtataaatattctacaaaaggttaatacaaacactttgatttattgctctgtagtgcacttttcaaagcctgttataaaagaggaaggaacatatgattgtggagcaggagagaagccaatgattctcaaggggacattggtggcggtttctcctcataatgacagactggaacagggaggttcctcaattgtgattaatccaaaagggggtggagttgacttccttggctggctttctggatttagctcttggtttgggggacctcttaaggctattttaatggtcattggtttccttctcctgggcctcatcttgtttgtgacaattgcgatcggccttaagtttgcactcagacaaatgatagttaaaaggatgaaatga

SEQ ID NO: 4657 - RNA, 3873 nt, synthetic construct; identical to SEQ ID NO: 4340
  misc_feature 1..3873: note = derived and/or modified CDS sequence (wt) from SFNV(Namru)__HM566169.1__GP
  source 1..3873: mol_type = other RNA

SEQ ID NO: 4658 - RNA, 3990 nt, synthetic construct
  misc_feature 1..3990: note = derived and/or modified CDS sequence (wt) from SFNV/SFNV-like(Poona)__HM566177.1__GP
  source 1..3990: mol_type = other RNA
atgttgaacgtaaaatctgtaattttaataacctgtctagtgcagcaggcccatctgaaatacacaattatttcagaggtggctaagggtgctagagaggtgagctgctacagctcaactacaagactagaccagttactagaagcctgggagaacaagagtgctctaatagggctcaagaggggcaactgcaaacttggtgctatggagcagataaactgcaaccttgatcttatgtcgaactatgtttctaatgtttatgacaacccacatggccttggggctatgatgtataatacagacagtgataagaggattgaggtgttgaatgaccagattcctgattctatgatccctggaggacacaactgcagtctacttgagagaaaaccattttgggctgacctcataccaccaaaaaaagaaaaagaattggatcctaaaccatctttaatctctcttgttcctactccaagggatgattttaagaagaagtttgaggaggctgaggaggaaatgaagaaaataaggaaggagttacagaatgaacgtcaggcacagttgagtgttatggaagacagtaggaagaaaatgagggacttagaagataggctcatgagacaatgggaagaggagaaacaaaagaagggactacttgaggaaactctagagaaagaaaggcaactaaagaataaggcccttcttgatgcacatgatttagataaacagttgaaagagagagatagagagtttaaaacagctatggaagaacatcagaacgagaggcgcaggataaacagcaacatgattaggccttatgtcactactccagcagctataatattaacttccctactatctgcaagtgtggttgtaggctttgagctggaaaacaggaacactaatcatgtgttgaatagacctggaaatggtggctactccattagtgataataatctaatagaagctaagtgcatgattacctatggtaccaaatgcctctcctgggagatgcaattaaaccctgtttcttaccccttcttctcttctaattttgagaaatacagtttattggaatctgtttcagagactacaccaataatagggaagttttcagaggtctgcgttctttcaaatttatcaggggctcagaaaacatgtgctaaggaggcaagtctcatcaagaaacagtgcccagatgatatcagagcctacttctacattaattccttgggtaaactcgcaattgttacatgtcctgagaataatgttttatctcaagactgtaatttctgtgtgcctaaagctaaaggagaacgatatatttacaaacctatccaggatggcttctgtcagaatggaggcgtttccactgttcccagtgttcgatattctaaagacatttgttctatagggccattaaaggttaaaaactgtcataaaggaacttctaggtacgaaaggacagcctttatatcaacaggagacaaaaaagtttacttggaggaggttaaaataaggtccaggcaagagtacgagcctgatcaatttctgtgctacaaagtgaaggatggatcttcatcacctcttgtctatgagaaagtccaagtatccaagtgtaagggcattgaaacaaatagtcctaaaaaatgcacaggagatgagtatttttgtagtaagtatccttgtgaatcaaccagccctgaggcgaattgttatctcaggaagcacagtgcaataatagaggtcaacattggagggatgtgggtcaaaccgaagtgtgtgggctatgagatggctctagttaagagagttggtcttagatctgaagatgtctctctgaaggagtgtgccacttgtttgtgggagtgctctagtagctacataagtattaccacacatgggcctaagatttcttatgcaactgcctgtagtcatgggtcttgcaagagtgtagtccaaagtccatcaacttccattaaaatcagctatccaggaaatagtgaaattgttggaggagacattggaatacacttaactgaagactcatcccctgttaatctccatttaaagattcactgtccacctaaagattcttgtgaagtaagtgattgtatcctttgtgttcatggattactaaattaccagtgtcattctgtggcttctgcgctccttctatccaccataatagcatctctaatagcgttagttgtctacatgctttccaaaactagatttgtgatgaggaaaattgtaccaattatgttcatcccattctgctggtgttttgtattgttggcctggttaaccagatcttggaaaggaaaggtaagaaatgcaattcaatcagccaataatacaattggatggactgagcgtgaagagagagtcatagcagagagaccaggaggcaggaatacaataaggtactcattttatggggttgttatactagcaatattggaatctgctttcggatgctcagagagtctcattgcagaatccaaaataatgcaatgcaatattgccaatgggaaaacaagctgtagggcttctgggacaatcatcatgaagctgggaccaataggatcagaggcttgtctaatccttaaggggctcagagatagcgacaagcagtacatatctgtgaaaactgaatctagtgagctaatctgcagagaaggagaatcattttggacttccttatacaccccagtctgcttgagctcaaggagatgccacttgatgggggagtgtacgggagacttatgcttgaagtggaaatctaataaaacatctttagaatttgctggtaagactcatagcgaagtcatgaatgagaataggtgctttgagcaaagtggcgggctaggatatggatgcttcaacatcaatccctcatgcctttatactcatgcttatctgaagtcagtctacagaaatggtttcagagtattcaagtgtgcttcttggacacatagagtcagattgacaattaccactcactctagaacattcccaatgaccttagcagcaatgagcacccagcctactgactggggctcgattggcctcattctagactcagaagggatttcaggaacaaattctttctcttttatgaagcatggattagggagctttgctataatagatgaaccgtattcaatggagcccaggaagggttttattggtgaagttagatgcccaacagaggaggcagccattaaggcctctaccctatgcaagacagcaccacaattgatagaataccaacctgagatggacagtgttgagtgcaccacaaacatgattgatccaatgagtatcttcaacagaggctctcttccacaagttagggagggaatgacttttactcagtcaatggagaagaacactgttcaagctatgactacaggagaggttcatgccagcataaggttagtgcttgatgactatgaagtagaatacctctcaaatcaggttgattgcgatgccactttcaagaatctgactggttgttattcatgtgatgagggtgctagagtgtgtatgcagattaaagcacacggagacactatattccacttcaaaaactctgatatgagcatgaacatcttacagaaggtcagcacgaacactctgatctactgctctgtcgtacacttctcaaaaccagtcataaaagaggaaggggtatatgactgtggagcaggagaaaaacctatgattctcaaaggaacgttagtggcagtgtctcctcacaatgataggctagagcaaggaggttcatcaatcgttatcaacccaaaaggaagtggagttgatttcttgggctggctttcagggtttagttcctggtttggagggccacttaaagctatcttaacagtaattggtttcctcctactaggattccttctattcatgttagtaacaattggccttagatatgctcttagtcaagtggtgaccaaaaagatgaaataa

SEQ ID NO: 4659 - RNA, 4002 nt, synthetic construct
  misc_feature 1..4002: note = derived and/or modified CDS sequence (wt) from Arrabida virus(PoSFPhlebV/126/2008)__KP863800.1__GP
  source 1..4002: mol_type = other RNA
atgttttatgcaaagtttatactactactctgtttcgtgcagggggctctcttgaaatataccattatttcaaaagtggggtctagcacatacaagagggtttgtttaagtcatactactgacctggacacactactagacatgaccagtagagaaatgagcaatatcaagctgactggaggatcctgcagcttaggtgatttgacaaagcctgattgctcacctgacttcttttcaaactatgtggccaacatccagagtagcaacaccaaaatcactggcaaattccaggacataattggagaaagagaaatggaggttaccaatgatgttgttccagatagttttggtcctgggccacatgactgcgttagttttgataagaagccattctggtcggaccttttgccaacaagtgtcagcaaggaggagccaaagcctatcatttccaccctctcagtgctacctgcagctccacctatcaaggactttagccacaaagttgtcgaggcagaggagatggtcaaagaaattgaaggtgaattgatgaaagagaaggaaagaaattctgccaaagaagaagaggctcgacaaagaatgagagaactggaagatgacctcagaaagcagtgggccgcagaaagaatggccaagcagaacatgagctctgtactagaaagggagagacaggaaaagcagagtcttgagaggagaatgcacgaggttgacaaaaagctaagagcatcagaagacagggcccagaaataccaagagagagctgaacaagctgagaagagccattcaaagctgctctctaggagtggggctgcgacgacaatggcaacagtagtctttacctccttgctagcttctgggttggcagttgtcactgaactagagaagagggatacaaaccacttactgaatagaccaggaaatggtgtttatatggcaaacgcagattcattgattcagacagagtgcaccctgaattatggacaaaggtgcttggcttgggagctgcagataacacctgttagatacccatttttcacgtcaaatgttgataagtatagccttctcgaatcaatcactgaaaccccatccatactagaaaagaacaatgagtcgtgtcagctggcaactacatcaggatcactgaagacttgcgcaaaagaagctagtaccataaagaagcattgcactgatgatgtccgtgctttcttcttcataaactctgtgggaaaacttacaattgtccgatgtgcagacaaccacattctgtcagaggactgcaatttctgcattagcaaggcaaggaattccaatcagaatatgttcatgccagtacaagatgcattctgtcagaggcagggatctgacactgcacccgcaatacgttactcaaaagatatctgctccattggtgcaataaagataaagcaatgtcacaaggcaacatctaaattcgagcggatgggtttcattagtgttgggcaaaagaagctatacattgaagagctcaaattgcgatacagacaagaatatgatccagatcagttcatgtgctataagattaagagcagcagtcctcttaaatatgaaaaagtgtcctccaagaaatgtaaggaggttgatactggtggaaaccaaaaatgcagtggggatgagcacttttgcaacagatacccctgcgacactgccaatcctgaagcacactgtttaacaaggaagcactcagccatagcagaagtaaacatcggaggtgtttggatcaggccaaaatgtgtgggttatgaaatggtcttggtgaagagaagtggtctcaaatcagaggacttgtcaataagagattgcccttcatgtctgtgggaatgtaaaaaaagcagaatcacaatcaaaactcatgggcccaaaatagtctcagcaactgcctgcagtcacgggtcatgcaagagtgtaatgcagaaaccatccacatttgtggaaataccataccctggaaacagtgaaattatcggtggagacataggagtccacatgacagagaggggctctccttctaacatccatgtgagaacacattgccctccaagggactcatgtgatgtttctgactgtatgttctgtgtgcatgggatcttgaactaccaatgtcatactctagcctctgccctgaccatagcaactatagtatcagctgtacttgttgtggtgtacttcctactggctagatctaaaagggcagtgaaattcatcacttctttattgattgttcctttcaagtggctaactcttctctctatatgggttgtgaagaactggaaaaggaagatgtcaaaactggccagggcaactaataatgctataggttgggatcaggatgtcgagaggggcagacctagagctgcagcaggacaccagaatcaagttgccaggtacacattttatggtgccacaatcttatcattgatgacctcaggactttgctgcaccgagagtgtgatcgctgaatctaacatcatgcaatgcacaactagtgacagtacgaccacatgcaaagccagtggcacaatcatcctcaggctgggccctattgggtcagaaagctgcttgattctaaaagggctgagagacagtgaaaagcaattcatatctatcagaacagtctccagtgagctaacatgtagagaaggagattccttctggacatctttgtacactccaatttgcctaagctccagacgatgccacctcatgggcgaatgcacaggggacaactgcttaaagtggcaggacaacaaaacatcatctgaatttacaggaaggacacatagtgaagtgctgcatgaaaacaaatgcttcgagcaaagtggaggcattggctatggttgctttaatgtcaatccatcctgcctgatggtccactcttatttgaagccaatctataagaatgcttttaaagttttccgctgtgttgcctggaaccacagagtgaaacttgccataaccacacataagaagagctttgatgtcaccctaatggccatgagcactcagcctactgactggggatcaattgggctaatcctagactctgaaggaatcacaggcacaaattcttactccttcatgaaatacggagtagggagttttgccattattgatgagccattttcaattgagcctagaaagggatttttgggagaagtccgctgccccacagaagaaactgctgtgaaagcgtcaccatcatgcaaggctgctccacaaatcattgaataccatccagaaatggacacagttgagtgcataacgaacatgatggatccaatggccatcttcaacaggggctcacttccacaggtgagagacggtgttacatttgctcagtcaattgaaaagaattctgttcaggctctgactactggagaaataaaagcaagtgtaagacttgttctagatgactatgaagtggagtacaaagttagtgagaatgactgtgattcaactttcatcaacattacaggttgctattcatgtgatgagggtgcaagattgtgtgtgagaatcaggacactgggtgactcaatctaccacttcaccgacagtgaggacatgatgaatgtcatgtttaaggtcaattcctcagtaactgagtattgtactgtactgcacttctctaagccagttgtcaactttgaaggcaagtatgactgtgggaagagcagaaagccaatgataattaagggcacacttattgccatggccccacatgatgatagagttcacagtggcggctcttccatagtcgtaaatcctaaaagcaagggagtggacttcctaggctggctatctgggctcagctcatggcttgggggaccattgaaaacagtcctcactgtgcttgggttcctcattttaggcctggtattcgttattgttgttatctttttggtcagggttgggatcagacaagcattgctgaagaaaatgaagtga

SEQ ID NO: 4660 - RNA, 4005 nt, synthetic construct
  misc_feature 1..4005: note = derived and/or modified CDS sequence (wt) from Massilia virus(127)__KT906100.1__GP
  source 1..4005: mol_type = other RNA
atgttttatgcgaagtttgtaataagcctctgcttagagccaggcttttctttgaaatatacaattatttcaaagtcagggtctggtactatcagacaaatctgcttaagtcattcgacggacattgataaggtcttggagctttccagtggggagatgaacacaattggcatcctgggaggcctctgcacatttggtgaacttaagagagaagactgttctccagatgtgttctctaattatgttgcaaatatgtatgggactgctcacccttcaagctgcaaattcgtggacataacaggggacaggagcattgaagttctaaatgatgctgttccagacagcttcacaccaggagcccacaattgcagtagcttcgaaaagaaaccattctggactgacctgattcctgctaagaacagctcaggagccataccttctgtggtttcagttttaccttctgtagctgaacatgattttaatctcaaagtgaaggaggccaatgataaattagaagtgattcaaagagagcttgcagcagagaaggcacgctcaggaaggctagaagatgaggcacgcgctaagatgaaggctttagaagatgagctaaggaatggatggctagctgaacgggaagccaaagaactggccaagtcagcgcttgaaaaggaacggatcaacaaattagaggtggaaagaaagctgcacgatctgggaaagaagttacgacaatcagaagacgatgttgagaaaatgagggtacatcataagaaggggaggaaggagtcggacgaggagatgaaaattgcaagaacaactgctcctagtgtatccacaactctggccactgttgttttcacatctctgctagccacaggactcgcagctattgagccaattgaggatagaaatgttaaccacatattgaataggccaggatcaggagtatacatggcttcaccaactctcacccaaaatgagtgctctcttgattacggaaaagaatgcaaggcctgggaattgcaagttagcccactacactacccattcttcacctctaatgtggacaagtatacctttttagagtccatcactctattgcctcctattctacttattaacaatgagttttgtgaactgaccactagttctggcccactaaaacaatgccagaaagaatccagcttgataaagaaatgctgtactgaagatgctagggcttactttttcattgacttagaaggtaaactatcgattgttcactgttcaaacaaccaggtgctctcggaagactgtaacttctgtgtgacaaagtcaggaggggtcagccacaagatcttcatgcctatacaagatgcattttgccaaaagggtgggtctgaatccattcctgttgtcagatactccaaagacatttgctcaataggactgtccaaggtgaagagttgtcacaaaagtacatctaggtatgagagaatgggatttattgttgcaggcaagaaaaaactgtacatagaggatttgaaaatgagatatcgacaagaatatgatgaggatcagttcttctgctataaagtgaataagacatctccattggaatatggcaaagagtccccttcaaaatgtaagggagttggctcaaatgagcagaaatgtaatggagatgaatacttttgcaacaggtacccttgtgaaactaatagtccagaggctcactgctctctgagaagacatgctgcagttgttgaggtttatgttggaggggcatggataaagcctaagtgtgtgggttatgagaaggtactggtcaagcgtggaggactcaagactgaggatctctctgttagagaatgcacaagctgtctttgggagtgtgaaaagaataaaattgtgataaagactcatggacccaaaattgtctctgctacagcctgtggaggtcgctcttggaaaagtgtgatgcaaaaaccatcaactttccttgatctcccataccctggcaatagtgagattattggtggggacagaggaaaccatctgagcgagcgaggatctccatacaacattcacagcactatacattctccaccagaagactctcgtgatgcttcagattgtatatactgtagacatggcctattaaattatcagagccatagcgtagaatcagcgatccttctgtcaacagtagttgctactattctggcactcactggggtggtcttgtccagatcaaaatctgccgtaaggtttctagcatctgcagtcgctgtcccattcagatgggtgtccctactggttgtttgggtgatgaaaaaatggaaggcgagagttgcaaccgctattagggccacaaacaatgctataggctgggacaacggccttgagcaggccagagtggagaatgcagcaaggagacaacagacagcaggcaggtggaggtcgctagatgcgtctaccattttatccgtcttgagcacaggattatgctgcactgaaagcctgattgctgagtctagtatcatgcaatgcaccacaggagaaggttcaacaacctgcaaggcaacaggaacagtggtattaaaactggggccaataggttctgagtcctgcttaatccttaaaggccttagagacaatgagaggcagtttatttccattaagactatttcgagtgagctaacttgtagagaaggggagtcattttggacaccgttatacaccccagtatgcttgagctcaagacgatgccatttaatgggtgaatgtacaggagacatgtgccttaaatggaaatctaacaaaacttcttctgaattcactgggaagacacacagtgaggtcattcatgagaacaagtgttttgaacagagtggaggaataggttatatgtgctttaatgtgaacccttcttgcttgatggtgcactcatatcttaaacccatctacaaaaatgcttttaaggttttcagatgcatagcctggaaccacagggtgcgtcttggcataacaacgcataagagaaagtttgaagtcaccctgatggccatgagcacacagcaggctgactggggctccattggtttaattctggattctgaagggatatcagggacaaactcctactcttttatgaagcatgggctagggagctatgccataattgacgagccatactctgtggaaccaagaaaaggctacctgggtgaggtgagatgtccaactgaagagacagccatcaaagcatcaccttcatgcaaagttgccccagggttggtagagtatcagccagagatggacacacttgaatgtacaaccaacatgatggacccaatggcaatcttcaacaggggatcattaccccaggtgagaggggggtggactttctcgcaatccatagaaaaaaattcacgacaggctctaaacacaggggcgattaatgccagtgtgagacatgttctagatgaatatgagtttgactacaaagtgaaaactaacgactgtgattctacatttgtgaatattacagggtgctattcctgcgatgaaggtgcaaggctgtgtgtgaaagtaaggacatcaagtgaagcaatataccactttactgactcaggctacaacataaatgtgctgttcaaagtggaatctggtgtgcatgatcactgcactattctacacttctcaaaacctgttatcagcattgaagggaagtatgattgtggaaaaaacaagaagcccatgctgatcaaaggaacactaatagccatggctcctcatgatgacagagtggttagcggaggctcttccactgtcgttaatcccaaaggccaaggagtggatttcttgggctggctatctcggttaagttcctggttcggtggaggtcctctgaagacatttttaatggtaacgggattccttatgactggggtgatcggtggtatagttactatcatcctgatacgaatagtgctacaacaggcactagccaagaaagttaagtaa

SEQ ID NO: 4661 - RNA, 4005 nt, synthetic construct
  misc_feature 1..4005: note = derived and/or modified CDS sequence (wt) from Massilia virus(130)__KT906101.1__GP
  source 1..4005: mol_type = other RNA
atgttttatgcgaagtttgtaataagcctctgcttagagccaggcttttctttgaaatatacaattatttcaaagtcagggtctggtactatcagacaaatctgcttaagtcattctaccgatattgacaaggttctagagctctctaggggggagatggacacaatcagcatcctaggaggcctctgcacatttggcgaactgaagagagaagactgttctcctgatgtgttctctaattatgttgccaacatgtatggaaccactcacccctcaagctgcaaatttgtggacataataggagacaggagcattgaagttctaaatgatgctgttccagacagcttcacaccaggagcccacaattgcagtagcttcgaaaagaaaccattctggactgacctgattcctgctaagaacagctcaggagccataccttctgtggtttcagttttaccttctgtagctgaacatgattttaatctcaaagtgaaggaggccaatgagaaattagaagtgattcaaagagagcttgcagcagagaaggcacgctcaggaaggctagaagatgaggcacgcgctaagatgaaggctttagaagatgagctaaggaatggatggctagctgaacgggaagccaaagaactggccaagtcagcgcttgaaaaggaacggatcaacaaattagaggtggaaagaaagctgcacgatctgggaaagaagttacgacaatcagaagacgatgttgagaaaatgagggtacatcataagaagaggaggaaggagtcggacgaggagatgaaaattgcaaagacaactgctcctagtgtatccacaactctggccactgttgttttcacatctctgctagccacaggactcgcagctattgagccaattgaggatagaaacgttaaccacatattgaataggccaggatcaggagtatacatggcttcaccaactctcacccaaaatgagtgctctcttgattacggaaaagaatgcaaggcctgggaattgcaagttagcccattacactatccatttttcacctctaatgtggacaagtacagcattctagagtccataactcaatcgtcgcccatactacttaagaacaacaactcttgtgagctaacaaccagccctggcacacaaaagcaatgccaaaaggaatccagcacaataaagaaatactgtactgatgacgctagggcttactttttcattgacttagaaggtaaactatcgattgttcactgtacaaataactacatactttcagaagactgcaacttctgtgtgagtaagttgggggaggtcggccacaaaatcttcatgcccatacaagatgcattttgccaaaagggagggtctgaatccattcctattgtcagatactccaaagatatttgctcaataggactgttcaagataaagaattgtcataagagtacatctaggtatgagagaatgggattcattgttgcaggcaagaagaaactgtacatagaggagctgaaaatgaggtatcgacaagagtatgatgaggatcagttcttctgctacaaagtgaagaagacatctccattggaatatgccaaagtgtctccatcaaagtgtaagggagttggttcaaatgagcagaagtgtaatggagatgaatacttttgcaacagatatccttgtgaaactaatagtccagaggctcattgctctctgagaagacatgctgcagtagttgaggtttatgttggaggggcatggataaagcctaagtgtgtaggttatgagaaggtactggtcaaacgtgggggactcaagactgaggacctctctgttagagaatgcacaagctgcctctgggagtgtgagaagaataaaattgtgataaagactcatggacccaaaattgtctctgctacagcctgcggtcatggctcttgtaaaagtgtgatgcaaaaaccatcaactttccttgatctcccataccctggcaatagtgagattattggtggggacagaggaaaccatctgagcgagcgaggatctccatacaacattcacagcactatacattgtccaccagaagactctcgtgatgcttcagattgtatttactgtagacatggcctattaaattaccagagccatagcgtagcatcagcgatccttctgtcaacagtagttgctactattctggcactcactggtgtggttttgtctagatcaaaatctgccgtaaggtttctagcatctgcagtcgctgtcccattcagatgggtgtccctactggttgtttgggtgatgaagaaatggaaggcaagagttacaactgccattagggccacaaacaatgctataggctgggacaatggtcttgagcaggtcagagtggagaatgcagcaaggagacaacagccagcagtcaggtggaggtcgctagatgcgtctaccattctatctatcttgggcacaggattatgctgtactgagagtttgattgctgagtctagcataatgcaatgcaccacagaggaaggttcaacaacctgcaaagcaacaggaacagtggtgctgaagttagggccaataggttctgagtcctgcttaatccttaagggccttagagacaatgagaagcaatttatttccattaagacaatctcgagtgagctaacttgtagagaaggggagtcattttggacatcgttatacaccccagtatgcttgagctcaagacgatgccatttaatgggtgaatgcacaggagacatatgccttaaatggaaatctaacaaaacttcttctgagtttactgggaagacacacagtgaagtcatccatgagaacaagtgtttcgagcagagtggaggaataggttatatgtgcttcaatgtgaacccttcttgcttgatggtgcattcatatctcaaacccatttataaaaatgcctttaaggtttttagatgtatagcctggaatcatagagtgcgccttggcataactacacataagagaaagtttgagatcactctaatggccatgagcacacagcagacagattggggctccatcggtttaattctagactcagaaggggtagcggggacaaatgcttactcattcatgaagcatgggctaggaagttttgctataatagatgaaccatactctgtggaaccaaggaagggatatttgggtgaagtgaaaggccctagagaagaaactgctatcaaagcatcaccctcatgtcaggttgccccagggctagtggaatatcagccagtgatggacacagttgaatgtacaaccaacatgatggacccattggcaatcttcaacaggggatcattaccccaggtgagaggggggtggactttctcgcaatccatagaaaaaaattcactacaggctctaaacacaggggcgattcatgccagtgtgagacatgttctagatgaatatgagtttgaatacaaagtgaaaagtaacgactgtgattctacatttgtgaatattacagggtgctattcttgcgatgaaggtgcaaggctgtgtgtgaaagtaagaacatcaagtgaagcaatatatcacttcactgactcaggctacaacataaatgtattgttcaaagtggattctggtgtgcatgatcactgcaccattctacacttctcgaaacctgttatcagcattgaagggaagtatgattgtgggaaaaacaagaagcccatgctaatcaagggaacactaatagccatggctcctcatgatgacagagtggttagtggaggttcttctactgtcgttaatcccaaaggccaaggagtggatttcttgggctggctatctgggttaagttcctggttcggtggaggccctctgaagacatttttaatggtaacgggattccttatgactggggtgatcagtggtatagttactatcatcctgatacgaatagtactacaacaggcactagccaagaaagttaagtag

SEQ ID NO: 4662 - RNA, 3999 nt, synthetic construct
  misc_feature 1..3999: note = derived and/or modified CDS sequence (wt) from Massilia virus(W)__EU725772.1__GP
  source 1..3999: mol_type = other RNA
atgttttatgcaaagtttgtaataatcctctgcttagtgcaaggcttttctttgaaatacacgattatttcaaagtcagggtctggtactatcaggcagatctgtttaagtcattccactgacattgataaagttctagaactctctagtggggagatggatacaataaatatccaaggaggtctctgcacattcggtgaattgaagagggaggactgttctccggatgtgttctccaattacattgccaacatgtacgggactactcacccttcaagctgcagattcctagatataatcggggataggagtattgaagtaatgaatgacgccagtccagacagcttcacgcccggagcccacaattgcagtagctttgagaaggcaccattctggtcagatttgattcctgcaaagaacggctctggcccttcaccatctgttgtctcagttctcccttctgcaacagaatctgactttagtctcaaagtaaaaaaggccaatgagagacttgaagtgattcagagagaacttgctgcagaaaaagcacgatctggaaggctagaggatgaagctcgtacaaagatgagggccctggaggatgagctaagaaatggatggctagctgaacgggaggccaaagagttagccaagtcagatcttgagaaagaacgggtcaacaaattagaggtggagaggaaactgcatgatctgaataaaaaattacggcagtcagaagatgaggctgagaggctgagagagtaccataacaaaagaaggaaggagtcggatgaaaagatgaaaatgactaagacagttgctcctaatgtgtccacaactctagcgactgtggtactcacatctctgctggccacagggcttgctgcaattgaaccaattgaagacagaaacactaaccacatactaaacagaccaggcacaggagtctacatggcttcaccaaccttaactgaaaatgactgttctcttgattatgggaaagagtgcaaggcctgggaactacaagtcagcccactacattaccccttcttcacttccaatgtggacaagtacagtctcctagagtccataactcaagcatcgcccatactgatcaaaaacaacaactcttgtgagctaacaactagccctggctcacagaagcaatgccagaaagaatccagcacaataaagaagtattgcactgatgatgctagagcttatttctttgttgacttagaaggcaacctctcaattgtacactgctcaaacaacaacatactctctgaggattgcaacttttgcataagtaagtcaggagtcaccggccagaaaatctttatgcctatacaagatgcattctgtcaaagaggaggatctgaatcacttccagtgattagatattccaaggacatctgctccataggactattcaaaatcaagagttgccataagagcacgtccaggtatgaaaggatggggttcattgttgtgggtcggaaaaagctatacctggaagaattgaagatgaggtatcgacaagagtatgatgaggaccaattctactgctacaaggccaagacaacatctcaattgcagtatcagaaggtgtcaccatcaaaatgtaagggagttggctcaaaagatcagaaatgtaatggagatgaatacttttgcaacagattcccatgtgaaaccaataacccagatgctcactgttctttgagaagacatgctgcagttgttgaggtcaatgttggaggggcatgggtaaaacccaaatgtgtaggctatgaaaaagtattggttaagcgtgggggacttaaaactgaagatctctctgtcagggaatgcaccagctgcctctgggaatgtgagaagaacaagattgttataaagacccatgggcccaagattgtttctgctacagcctgcagtcatggttcttgtaaaagtgtgatgcagaaaccatcaactttccttgacctcccgtatcctggcaatagtgaaattataggcggagacataggaatccatatgagcgagcggggatcaccatccaacattcacatcactatacattgtcctccaaaagactcttgtgatgtttcagattgtattttctgtagacatggcatattaaattatcagtgccatagcgtagcatcagcgatccttctgtcaacagtagttgctactattctggcactcactggtgtgattatatctaggtctaaatttgctgtgagattcttggcttctgcagtagccatcccgttcaggtgggtgtccttattagtcgtatgggtaatgaagaaatggaagtcaagaattgcaacagccattagggctacaaacaatgctattggttgggataatggccttgagcaggtcagagtggaaaatgcagccagaaggcctcaaccagcagtcaggtatgcattctatgcaaccaccatcctttctattttgggttccgggctgtgctgtactgagagtttgattgctgaatctagcataatgcaatgcaccacagaggatagctcaacaacctgcaaagcaacaggaacagtggtgttgaagttagggccgataggttctgagtcatgtttgattctcaaaggtctcagagacaatgagaagcaatttatctccatcaagactatctcaagtgaactaacctgtagagagggagagtcattttggacctcattatacaccccggtgtgcctaagttctcgacgatgccatctgatgggtgagtgcactggggatatctgccttaagtggaagtccaacaagacatcttctgaatttactggaaaagcacacagtgaggtcatccatgaaaataaatgctttgagcagagtggaggaataggttatggatgcttcaatgttaacccctcttgcctgatggttcactcatatctcaagcccatctacaaaaatgctttcagggtcttcagatgtatagcttggaatcatagagtgcgccttggggtaactacacataagaggaagtttgagatcactttaatggctatgagcacacagcaaacagactggggttctattggcctgattctagattctgaagggatagaagggacaaatgcttactcattcatgaagcatggattagggagttttgccatagtggatgaaccatattctgtggagccaagaaaaggctatttgggtgaagtgagatgcccaacagaagaaactgccattaaggcttcaccttcatgcaaagtcgccccagggctcatagagtatcagccagaaatggacacggtcgagtgcacaacaaacatgatggatcccatggcaatcttcaatagaggatcgttgccacaagtcagagaaggaaagactttcacacaatccatagagaaaaattcagttcaggctctaaccacaggggagattcatgccagtgtgagacttgttctagatgagtatgagattgaatacaaagtgacaagtaatgattgtgattccacatttgtgaatataacagggtgctactcctgtgatgaaggcgcaaggctatgtgtgaaagttaagtcatcaagtgaggcaatataccattttactgactcaagcttcagtgtgaatgtcctgttcaaggtgactcctagtgtacatgactactgcaccattctgcatttttcaagacctgttattagtattgaggggaagtacgattgtggcaagaacaagaagcctatgctaatcaagggaaccctgatagctatggctcctcatgatgacagagtaatcaatgggggctcatctactgttgtcaaccctaaaggacatggagtggacttcttgggctggctatcaggattaagttcttggtttggaggccctctgaagacttttttaatggtaatgggattccttatgattggtgtgatcattgttatagtcactatcatcctgattcgaataggactacaacaggctctagccaagaaatttaagtag

SEQ ID NO: 4663 - RNA, 3996 nt, synthetic construct
  misc_feature 1..3996: note = derived and/or modified CDS sequence (wt) from Punique virus(PI-B4-2008)__JF920134.1__GP
  source 1..3996: mol_type = other RNA
atgttttatgcaaagtttgtaataatcctctgcttagtgcagggcttttctttgaaatatacaatcatttcaaagttagggtctggcactacaagacaagtttgcttaagccactcaactgacttggataaggttcttgaaatttccaatatggagatggatgccatcaacttgctgggtggtttctgtacacttggagaattaaggagggaagattgctcccctaacgtgttctcaaactatgttgtcaatgtacacgggacaatacattcatccaattgcaagtttgtggacatagttggagacaggagtattgaagtccttaatgatgctacaccagatagctttactcctggagcccacaactgtagcagttttgaaaaaccacctttctggactgacctggttccaaaaaagaacgatacagacccttctccttctcttctctctgtgctccctgctgctgccgagcttgactttaatctaaagctgaaagaggccaatgacaaggtggaagctattcagagggagttagttgctgagaaggcaaggtctgggagaatagaagatgaggctcgcacaaaaatgagggaattggaagatgagctaagaagaggctggattgctgagcgggaagcaaaggagctggctcataagaatctggaggaagagagggtaagtaagcttgagatagaaaggaggatgcatgatcttgacaagaaattaaggcagtccgagaatgacgctgatcgactgagagagcagtacaacaagaaaagaaagtcagaagaagaagtgaaaactccaaaagcatcgacacttaatgcgacaactacactggctacagtggtcctcacttctttgttggctactgggcttgctgctattgaacagattgaagagagaaacacaaaccatattttgaacagaccagggacaggagtgtacatggcctcaccgacacttactcagacagaatgttcacttggttatggcaaggagtgtaaatcttgggaactgcaagtcagtccattacattaccctttcttcacttctaatgtggacaagtacagcattttagaatctatcactcaggagccaactctactgatcaaaaacaacaattcttgtgaattgacaacaagtcctggatctcagaaacagtgccaaaaggaatctagtaccataaagaagtattgtactgatgatgctagagcctacttctttattgatctaggaggaaatctatcaattgttcactgctcaaataacttcgttctttcagaggattgcaatttctgcatcagcaagtctggaggggttggccagaaaatcttcatgccaatacaagatgcattctgtcagagagggggatcagagtcacctccagtagtcagatactctaaagacttgtgctctataggactcttcaagattaaaagctgccataaaagcacatcaaggtatgagagaatgggtttcatagtggcagggcagaagaagctgtacttagaagaattaaagatgaggtacagacaagagtatgatgaggaccagttcttttgttacaaggtaaagtcaaactctccacttcagtatgaaaaggtgtcaccatccaaatgcaaaggggttggatcacaagatcagaagtgcaatggagatgagtacttctgcaataggtatccttgtgatactaataatccagatgcacattgctccttaagaagacatgctgcggttgtcgaggttaatgtcggtggtgtttggattaagccaaagtgtgttggctatgaaaaggtcttagtcaaaagagggggtttgaagactgaagacctatcagtcagagaatgtactagctgtttatgggaatgtgagagaaacaaagttgttgtaaagactcatggccccaagattgtctctgccactgcttgtagtcatggatcttgcaagagtgtcatgcagaaaccatcaacattcctagagatcccttatcctggaaatagtgaaattataggtggagatattgggattcatatgagtgagcgaggctcaccttctaacattcatgttgttgttcattgcaagcctaaggattcttgtgatatctcagattgcattttctgcaagcatggaatactgaattaccaatgccatagtgtagcctcagcagtcctcctctcaacgatgattgctgcctgtctagctcttgttggagtgatagtatccagatcaaagcatgcagttaaattcctagcatctgtagtggcaataccattcaaatgggtgtctctactaactgtctgggttgtgaagaattggaagctcaggataacaagagtcataagagccacaaatgatgcaataggctgggaaaacaatcttgaacaagttagagtggaaaatgctgcaagaagacctcaacccgcagtcagatatgccttttatggaacaactatcctctcaattctaagtactggcctgtgttgttcagaaagcttgatagctgaatcaagcataatgcagtgcaccaccgaggatagctcaactgtatgcaaagctactggaaccgtggtcctgaaattgggaccaattggctctgaatcatgcctgatcctgaaaggtcttagagacaatgagaagcagttcatatccataaagactatttctagtgagttgacttgcagagaaggagagtcattctggacctcattgtacaccccagtatgtctaagctctcggaggtgtcacttaatgggtgagtgcactggagatatatgcctcaagtggaaaactaataaaacatctgctgaatttactgggaagactcatagtgaggtcattcatgagaacaagtgctttgaacagagtggaggaatgggttatggatgttttaatgtcaacccatcatgcttgatggttcactcatatcttaagccgatctacaaaaatgcattcaaagtctttaggtgtgtagcttggaatcatagggtccgtcttggcataacaacacacaaaaggaattttgaaatcactctgatggcaatgagtacacagcagacagactggggttcaataggtttgattctagactctgagggaatcactggtacaaattcctattcctttatgaaacatggattggggagctttgctataatagatgaaccttatgtgactgagcctcgaaaaggctatttgggcgaagttagatgtcctacagaagagactgcagtgaaagcttctccatcatgcaaagtcgcgcctgggttgatagagtaccagccagagatggatgtggtggaatgcacgacaaacatgatggatcctatggcgatcttcaacaggggttctttgcctcaagtcagagatggaaagacattcactcagtccatagaaaagagctcagtccaagcgttaacaacaggggaaattcatgctagtgtgaggcttgttcttgatgaatatgaagttgagtacaaagtggtcaataatgattgtgattctacctttgtgaacatcacagggtgctattcttgtgacgagggtgccagactctgtgtaaaggtaaaagcttctagtgatgtaatataccatttcactgactcagacaacagtatgaatgtcctctttaaggtttcttccaacatccaggattattgtatagtcttacacttttcaaagcctgttgtcaatgttgaaggcaagtatgattgtggcaggagcaagaagcctatgctgattaagggcactctaatcgccatggcacctcatgatgacagagtaacaaacgggggttcatcaattattataaatcccaaaggaggtggagttgatttcttagggtggctatcaggattgagttcttggtttggtggtcctttaaaaactttcttaataattgcagggttcctcattgtaggtataataatagtcataatcatcataattctggcacggcttgggattcagcaggcattggcaaagaaattaaaataa

SEQ ID NO: 4664 - RNA, 4020 nt, synthetic construct
  misc_feature 1..4020: note = derived and/or modified CDS sequence (wt) from TOSV(9028)__KU904264.1__GP
  source 1..4020: mol_type = other RNA
atgtttattgcaaagttgttattaatttcctgtttagtgcagcaggcctatctgaaatatactattatttcagagatagggaacggcactagaacttccttttgctacagttcaagaactagcttggggagcctcttagaagcttgggacaacgtgactgagtcaattggcctgacttctggcacttgcaaagtggggtcactggagaacagggactgcaggaaagacataatgtccaactacgttgctgaggtgcactctgacctgcacgggctgggagctatgatgcacaactacggtgatgacaagagggttgagatcctcaatgatgtcataccagatgagctcaatcctggacaccacaactgtagtgaccttgaccgaaagccattttggactgagtttattaatgtggcaaagccattgagtgaaatagtcccaatgtcagtgattccaccaccagttgtgaagctccagccacctgcagaaccatcctccaagaaacatgttccgtttgatgtacttttgtcagaagctgagaaggagctaaaccagacaaagattagactggaagatgagagaaagtccaatgcagaagagacagcaaaggagagggctaggatgaaggagattgaggatgaattgagaagggagtgggagctggaacggaagaggaaggacgcaatggcagatgatttagcaaaagaaacagcaagaaggagggagatagaaaggaaggcccatgagcttgataaaatgcttaagaagaaggagcgcgaaagcctgattgcaaaagagaaagcagatgaggacatgagaagccatgtgcataaaccaaacacgactagagccccagcacccacaattatcaccactctgctcatggcgagtgcagccctagcgggacccctggagaacagggagacaaatcatttgctcaacaggccaggaaatggggcttacactctaagcgactttgctgaatcaacctgcacactggcctatggatcagaatgcaaatcttgggagcaccttctgaatgaggagctgttccccttcttccattctaatcttgacaagtacagcatgctagaagctgcaacagagacagtacctatactcaataagagctctgcagtttgcaccatttctccttccacacattcatcgaatgcctgtgggagagaggctagtgtcattaggaagaaatgttatagtaacatgtcagccttcttctacattaacctggcaggtcaaattactgtgattaagtgtgaaacaaaccacgtcctttctagtgattgtggaaattgcatctccaagagcttgagtggccaaaaggtatacaccccagtgcaagatgtgttctgtcagaagggctggacacagtccatcccaagcacaagatattcaaaagacatctgttctattggtttgcacaccgtgaaggaatgcaagataggaaccactagctttgagagggtgggtttcatagttgtgaaaggccgcaagatgtacattgagcagatgaagatgagatcaaggcaggaatacagcgaagatcaatttttgtgctataaatcagaaagcggctctggctcatctgtcaagctaaagaagttcaaggttgaatcatgcaagggtgttactacatcatcagcctctaagtgctctggcgatgagtatttctgcagcaggtatccatgtgaaacagccaacgttgaagcccactgcattctaaggaggcatagtgcaatagtggaagtgaatgtcaacggcgtgtgggttgtgcctaggtgtattggctatgaggaggttctggtcaaaaggacatcactcaaggttgaagatacgacaggaagggaatgtgattcctgcttatgggaatgtgggaagaataagctgattgtcaagactcatggtcccaaagtggtttatgcaacagcatgcagccatggatcctgtaaaagtgtgatgcagaagccagcaacctttgtgtacctaccataccctggaaatagtgaaattgttgggggtgacatagggattcacatgacagaagagtcatcaccctcgaatatacacttagtagcacactgccctgcaagggactcatgtgatgtcagtgactgtctattctgcgttcacggactccttaattatcagtgccacaccttgttttcagcattgctcatatcaactactgtgatgtcaattctcacattgctgctcttgcttgtgaaaggggcaaaggatcttgttaagaaattgttccactggctgatcactcctttatgctggctatcagtcttttgctgctgggtggttaaaagctggaaaagaagagtgggttcagcaatttctaggacaaacgacactattggttggcgtgaaaacaggcggcatgctcaagacattgagagagcacagtacacaggaggggctccaggggccaaatattcattttatggggttatgattctaggattactgagtagtgctcagagttgctctgaaagtgtgatagcagactccaagatcatgcaatgcacaacctcagggagttccaccctttgcaaggcaagcgggacagtaatcatgagattgggacccataggctcagagtcttgtttgattctgaaagggctcaaggacagtgaaaagcagttcatatctatcaagaccatatcaagtgaactcacgtgccgagaaggagaatctttctggaccaccctatacacacctatctgcttaagctcaagaagatgtcacttgatgggagaatgtgtctctgatcgctgcctcaagtggaagactaatcaaacatccgcagaactcacagggaaagcacatggtgacgttatgcacgagaacagatgctttgagcaaagtggaggaataggctacggatgttttaacgtaaacccttcttgtctctatgtccactcttatctcaagtctgtttacaggaacgggttcaaagttttcaggtgtgtggcatggaatcataggattagactagaggtgacgacacactcccgaaagttccctatggttttgatggccatgagcacacagcccactgactggggatccattggtttgattcttgactcagaagggataacaggaacaaattcttattcctttatgaaacatggctcaggaagttttgctataatagatgacccatattctccagagcctcgaaaagggttcctgggagaagtgcggtgtcctacagaagagacagccatgcgagcatcaccttcttgcaagatggctccaaacttgattgagtatcagcctgaaatggacacagcagagtgtaccacaaatatgatagaccctatggctatattcaatcgaggatctctgccacaggttcgggatgggatgactttcacgcaatcaatagaaaagaacactgttcaggcattaacaacaggggaagttaaggcatccatccgcctcatattagatgattatgatgtggtgtatcaaaatagccagtctgactgctcagccacattcaagaacctcactggttgttactcatgtgatgaaggatccagactatgctatcaagtgaaggcagaaggcgagactatttttcactttatcaatgaagaagagtccatcaatgtcatcaataaggtaagcccgggagtgagcgactactgcaccgttctccatttctcaaggcctgttatttctattgagggaacatatgactgcgggctaagcaagagaccaatggtgataaaaggtactctaattgccactgctccacatgatgatagaaagcatgaaggaggttcttctttagtagtcaaccccaaaggtggttcagttgacttctttggatggttgtctggattgacctcatggctcggaggtcctctcaaaacatttctgactattcttggattcctagctgtgggcttactgttggtggtgataattatcatcatcattcggactggaatgcaacaagctttgaagaagaagataaaataa

SEQ ID NO: 4665 - RNA, 4020 nt, synthetic construct
  misc_feature 1..4020: note = derived and/or modified CDS sequence (wt) from TOSV(A189)__KP694241.1__GP
  source 1..4020: mol_type = other RNA
atgtttattgcaaagttgttattaatttcctgtttagtgcagcaggcctatctgaaatacactattatttcagaaatagggaacggcactagaacttcttcttgttatagctcaagaaccagcttggggagccttctggaagcttgggacaacataactgagtctattggtctgacgtctggcacttgtaaagtgggatcactggagaacagggattgcaaaagagacatcatgtcaaattatgttgcagaagtgcattccaacttacatggcctgggagctatgatgcacaactatggtgatgacaagagggttgaggtcctcaatgatgtcatcccagatgagctcaatccagggcgccacaactgcagtgacctagaccggaagccattttggacagagtttattaatgtggcgaggccaacgaacaaaatggctcctatgtcagtgatcccaccaccaattgtaaagcccataccagttgcagaaccaaccattgagaaaaccatcccatttgataaactcctatctgaagcagaaaaggagttgaaccaaacaaaaatcagattggaagccgaaagaaggtctaatgcggaagaggctgcaaaagaaagggccaggatgagagaaatagaagacaagctgagaaaggattgggagttggaacgggagagaaaagatgcagtggcagacgacctggcaaaagaaatagcgagaagaagagagatagagagaaaagctcacgaattagataagatgctcaagaagaaggagcgtgaagatctggtggcaagagaaagggtgagtgaggatatgagaaaccatgtgcgtagaccaaatacaaccatagcccctgctcccacaatcattaccaccctgctcatggccagtgcagtaatggcaggacctttggagaacagggaaacaaaccacttactaaacaggccagggaatggagcttacaccctaagtgactttgctgagtccacctgcacgctagcttatggctcagagtgcaaatcctgggagcaccaattagatgagctgtcttttcccttcttccactctaaccttgacaagtacagcatgctagaggctgcaacagagacagtaccgatactcaacaagagctcagctgtctgcacaatttaccatccacgcattcatcgaatggcatgtggtagggaagccagcctcataaagaagaaatgtggaagcaatatgtcggctttcttctatgttaacctagccggtcagataactgttgtcaagtgtgatacaaaccacgtcttgtctaacgactgtgggaattgtatctcaaaaaccttgagcggccagaagatttataccccagttcaggatatgttctgtcagaaaggctggacagagtccatcccaaacacaaggtactctaaagacctctgttctattggcttgcacactgtgaaggaatgcaaaactggtaccaccaactttgagagagtgggcttcattgttgtgaagggtcgaaagatgtacattgagcagatgaagatgagatcgaggcaagaattcagcgaagaccagttcttatgctacaaatcagagagcagttctggctcttctgtaaagctaaagaaggtcaaggttgagtcatgcaagggtgttacaacatcatcagcctctaagtgctctggggatgaatatttctgcagcaggtacccatgtgaaactgcaaatgttgaagcccattgcattctacggaggcatagtgcagttatagaagtgaatgtcaatggcgtatgggttgtgccgagatgcattggttatgaggaggttcttgttagaaggacttcactcaaagtggaagatacatccagtagagaatgtgatacctgcttatgggaatgcgggaaaaataaactaattgtcaagactcatggtcctaaaatagtttatgcaacagcatgtagccatgggtcttgcaaaagtgtgatgcaaaagccagcgacctttgtatacctgccgtacccaggaaacagcgagattgttggaggtgatataggggtccacatgacagaggaatcatcaccttcaaacatacacatggtggcacactgccctgcgaaggattcatgtgaggttagcagctgcctattctgtgtgcacggactgcttaattaccagtgccacaccttgttctctgcactactaatatccaccactgtgatgtccattcttacactgctacttcttcttatgaggggagctaaagatcttgtcaagagattattctactggctaatcacacccctgtgctggctatcagtgttctgtagctggatgatcaaaagctggaaaaagagagtgggctcagctatttctagaaccaatgacaccattggttggcgtgacaatagacgatatgggcaagacgttgagagagcacagtacacaggaggagctccgggggctaaatactcattttatggagtgatgatccttggcctattaggtaatgtgcatagttgctctgagagtgtcttagccgactccaaaatcatgcaatgcacaacttcaggaagttctaccctctgcaaggctagtgggactgtgattatgaagttagggcctataggctcagagtcctgcctgattttgaagggtcttaaggacagtgaaaagcaattcatctcaatcaagaccatatcaagtgaactcacatgccgagagggagagtccttctggactactctatatactcctgtctgtctaagctcgcgaaggtgccacctgatgggagaatgtgtctctgaccgctgcctcaaatggaaaaccaatgaaacatctgcagaattcactgggaaggcacatggagaagttatgcatgagaataggtgctttgagcagagcggtggaataggctatggatgctttaatgtgaacccttcttgtctctacgtccattcatatctcaaatctgtctacaagaatggatttaagatctttagatgtgtagcatggaaccataggattagacttgaagttactacccactcccggaaattcccaatggtattgatggctatgagcactcaaccaactgactggggttctattgggttaatcctagattcagaagggataacagggactaacgcgtattcctttatgaagcacgggtcaggaagctttgccatcatagatgacccatattccccagagcctcgtaaaggctttttaggagaagtgcgatgtccaacagaagagacagctattcgggcgtcaccctcatgtaagatggcccctaacttgatcgagtaccagcctgagatggacactgcagagtgcactacaaacatgatagatcccatggccatattcaatcgagggtccttgccacaagtccgggatggaatgacattcacccaatcaattgagaagaacacagttcaagcactgacaacaggagaggttagagcttctatacgcctcacattggacgactatgatgtggtgtatcaaaatagtcagtccgactgctcagctacatttaagaatctcactggctgttattcatgtgatgagggttccagaatgtgctaccaggtgaaggcagaaggagaaactatctttcactttgtcaatgaggatgaatccatcaatgtcattaacaaggtgagcccagacgtgagtgactactgcactgttctccacttctcaagacctgtcatctccattgaagggagatatgactgcgggcttagcaaaagaccaatggtgataaaaggtactctaattgctactgccccgcatgatgacaggaagcatgaaggaggctcctcattggttgtcaaccccaaaggcggcacagttgacttcttcggatgggtgtctggactgacctcatggctaggtggacctcttaaaaccttcttgaccatccttggattcctagctctaggcctacttttagtagtgataatcattatcattgctcgcactggggtgcaacaggccctgaaaaagaaaaacaagtga

SEQ ID NO: 4666 - RNA, 4020 nt, synthetic construct
  misc_feature 1..4020: note = derived and/or modified CDS sequence (wt) from TOSV(AR)__EF656362.1__GP
  source 1..4020: mol_type = other RNA
atgtttattgcaaagttgttattaatttcctgtttagtgcagcaggcctatctgaaatatactattatttcagagatagggaacggcactagaacttccttttgctacagttcaagaactagcttggggagcctcttagaagcttgggacaacgtgactgagtcaattggcctgacttctggcacttgcaaagtggggtcactggagaacagggactgcaggaaagacataatgtccaactacgttgctgaggtgcactctaacctgcacgggctgggagctatgatgcacaactacggtgatgacaagagggttgagatcctcaatgatgtcataccagatgagctcaatcctggacaccacaactgtagtgaccttgaccgaaagccattttggactgagtttattaatgtggcaaagccatcgagtgaaatagtcccaatgtcagtgattccaccaccagttgtgaagctccagccacctgcagaaccatcctccaagaaacatgttccgtttgatgtacttttgtcagaagctgagaaggagctaaaccagacgaagattagactggaagatgagagaaagtccaatgcagaagagacagcaaaggagagggctaggatgaaggagattgaggatgaattgagaagggagtgggagctggaacggaagaggaaggatgcaatggcagacgatttagcaaaagaaacagcaagaaggagggagatagaaaggaaggcccatgagcttgatagaatgcttaaaaagaaggagcgcgaaagcctgattgcaaaagagaaagcagatgaggacatgagaagccatgtgcataaaccaaacacgactagagccccagcacccacaattatcaccactctgctcatggcgagtgcagccctagcgggacccctggagaacagggagacaaatcatttgctcaacaggccaggaaatggggcttacactctaagcgactttgctgaatcaacctgcacactggcctatggatcagaatgcaaatcttgggagcaccttctgaatgaggagctgttccccttcttccattctaatcttgacaagtacagcatgctagaagctgcaacagagacagtacctatactcaataagagctctgcagtttgcaccatttctccttccacacattcatcgaatgcctgtgggagagaggctagtgtcattaggaagaaatgttatagtaacatgtcagccttcttctacattaacctggcaggtcaaattactgtggttaagtgtgaaacaaaccacgtcctttctagtgattgtggaaattgcatctctaagagcttgagtggccaaaaggtatacaccccagtgcaagatgtgttctgtcagaagggctggacacagtccatcccaagcacaagatattcaaaagacatctgttctattggtttgcacaccgtgaaggaatgcaagataggaaccactagttttgagagggtgggtttcatagttgtgaaaggccgcaagatgtacattgagcagatgaagatgagatcaaggcaggaatacagcgaagatcaatttttgtgctataaatcagaaagcggctctggctcatctgtcaagctaaagaagttcaaggttgaatcatgcaagggtgttactacatcatcagcctctaagtgctctggcgatgagtatttctgcaacaggtatccatgtgaaacagccaacgttgaagcccactgcattctaaggaggcatagtgcaatagtggaagtgaatgtcaacggcgtgtgggttgtgcctaggtgtattggctatgaggaggttctggtcaaaaggacatcactcaaggttgaagatacgacaggaagggaatgtgactcctgcttatgggaatgtgggaaggataagctgattgtcaagactcatggtcccaaagtggtttatgcaacagcatgcagccatggatcctgtaaaagtgtgatgcagaagccagcaacctttgtgtacctaccataccctggaaatagtgaaattgttgggggtgacatagggattcacatgacagaagagtcatcaccctcgaatatacacttagtagcacactgccctgctaaggattcatgtgatgtcagtgactgtctattctgcgttcacggactccttaattatcagtgccacaccttgttttcagcattgctcatatcaactactgtgatgtcaattctcacattgctgctcttgcttgtgaaaggggcaaaggatcttgttaagaaattgttctactggctgatcactcctttatgctggctatcagtcttttgctgctgggtggttaaaagctggaaaagaagagtgggttcagcaatttctaggacaaacgacactattggttggcgtgaaaacaggcggcatgctcaagacattgagagggcacagtacacaggaggggctccaggggccaaatattcattttatggggttatgattctaggattactgagtagtgcccagagttgctctgaaagtgtgatagcagactccaagatcatgcaatgcacaacctcagggagttccaccctttgcaaggcaagcgggacagtaatcatgagattgggacccataggctcagagtcttgtttgattctgaaagggctcaaggacagtgaaaagcagttcatatctatcaagaccatatcaagtgaactcacgtgccgagaaggagaatctttctggaccaccctatacacacctatctgcttaagctcaagaagatgtcacttgatgggagaatgtgtctctgatcgctgcctcaagtggaagactaatcaaacatccgcagaattcacagggaaagcacatggtgacgttatgcacgagaacagatgctttgagcaaagtggaggaataggctacggatgttttaacgtaaacccttcttgtctctatgtccactcctatctcaagtctgtttacaggaacgggttcaaagttttcaggtgtgtggcatggattcataggattagactagaggtgacgacacactcccgaaagttccctatggttttgatggccatgagcacacagcccactgactggggatccattggtttgattcttgactcagaagggataacaggaacaaattcttattcctttatgaaacatggctcaggaagttttgctataatagatgacccatattctccagagcctcgaaaagggttcctgggagaagtgcggtgtcctacagaagagacagccatgcgagcatcaccttcttgcaagatggctccaaacttgattgagtatcagcctgaaatggacacagcagagtgtaccacaaatatgatagaccctatggctatattcaatcgaggatctctgccacaggttcgggatgggatgactttcacgcaatcaatagaaaagaacactgttcaggcattaacaacaggggaagttaaggcatccatccgcctcacattagatgattatgatgtggtgtatcaaaatagccagtctgactgctcagccacatttaagaaccttactggttgttactcatgtgatgaaggatccagactatgctatcaagtgaaggcagaaggcgagactgtttttcactttatcaatgaagaagagtccatcaatgtcatcaataaggtaagcccgggagtgagcgactactgcaccgttctccatttctcaaggcctgttatttctattgagggaacatatgactgcgggctaagcaagagaccaatggtgataaaaggtactctaattgccactgctccacatgatgatagaaagcatgaaggaggttcttctttagtagtcaaccccaaaggtggttcagttgacttctttggatgggtgtctggattgacctcatggctcggaggtcctctcaaaacatttctgactattcttggattcctagctgtgggcttactgttagtggtgataattatcatcatcattcggactggaatgcaacaagctttgaagaagaagataaaataa

SEQ ID NO: 4667 - RNA, 4020 nt, synthetic construct
  misc_feature 1..4020: note = derived and/or modified CDS sequence (wt) from TOSV(EsPhGR40)__FJ153283.1__GP
  source 1..4020: mol_type = other RNA
atgtttattgcaaagttgttattaatttcctgtttagtgcagcaggcctatctgaaatatactattatttcagagatagggaacggcactagaacttccttttgctacagttcaagaactagcttggggagcctcttagaagcttgggacaacgtgactgagtcgattggcctaacttctggcacttgcaaagtggggtcactagagaacagggactgtgggaaagatataatgtctaactacgttgctgaggtgcactctaacctgcacgggctgggagctatgatgcacaattacggcgatgacaaaagggttgagatcctcaatgatgtcatcccagatgagctcaatcctggacaccacaactgtagtgaccttgaccgaaagccattttggactgagtttatcaacgtggcaaagccattgagtgaaatagccccaatgtcagtgatcccaccaccagttgtgaagctccagccacctgcagaaccatcctctaagaaacatgttccgtttgatgtacttctgtcagaggctgagaaggagctgaatcagacgaagattagactggaagacgagaggaagtctaatgcagaagagacagcaagagagagggctaggatgagggatattgaggaagaattgagaaaggagtgggaactggagcggaagaggaaggacgcaatggcagatgatttggcgaaagaaacagcaaaaaggagagagatagagaggaaggcccatgagcttgatagaatgcttaaaaagaaggagcgcgagagcctgattgcaaaagaaaaggaagatgagaacatgagaagccgtgtgcataaaccaagcacaactagagccccagcgcctacaatcatcaccactctactcatggcaagcacagccctagcgggacccttggagaacagggagacaaatcatttgctcaacaggccagggaacggagcttacactctaagcgactttgctgagtcaacctgcacattggcctatggatcagaatgcaaatcttgggagcaccttctgaatgaggagctgtttcccttcttccactcaaatcttgacaagtacagcatgttggaagctgcaacagaaacagtgcctatacttaataagagctctgctgtttgcactatttctccttctacacattcatcaaatgcctgtggaagagaggctagtgtcatcaggaagaaatgttatagtaacatgtcagcactcttctacattaacctggcaggccaaatcactgtggtcaagtgtgaaacaaaccatgttctttctagtgactgtggaaattgcatctcaaagagcttgagtggccaaaaggtatatactccagtgcaagatgtgttctgtcagaagggctggacagagtctatcccaagcacaagatattcaaaagatatctgttctattggtctgcacaccgtgaaagaatgcaagataggaaccactagctttgagagggtgggtttcatagtcgtgaaaggccgcaagatgtacattgagcagatgaaaatgagatcgaggcaggaatacagtgaggaccaatttttgtgctataaatcagaaagtggctctggttcatctgtcaagctaaagaagttcaaggttgagtcatgcaagggtgtcactacatcatcagcctctaagtgctctggcgatgagtacttctgcagcaggtatccatgtgagacagccaacgttgaagcccactgcattctaaggaggcatagcgcaatagtggaagtgaatgtcaacggagtgtgggttgtgcctaggtgtattggctatgaggaggttctggtcaaaaggacatctctcaaggttgaagatacgacagaaagggaatgtgattcctgtttgtgggagtgtgggaagaataaactgattgtcaagactcatggtcccaaagtagtttacgcaacagcatgtagccatggatcctgtaaaagtgtaatgcagaagccaacaaccttcgtgtacctaccataccctggaaatagtgagattgttggaggtgacatagggattcacatgacagaagagtcatcaccctcgaatatacacttagtggcacactgccccgcaagggactcatgtgatgtcagtgactgtctattctgtgttcacggactcctcaattatcagtgtcacaccttgttttcagcattgctcatatcaactactgtgatgtcaattctcacattgctgctcttgcttgtgaaaggggcaaaggatcttgttaagaagttgttttactggctaatcacacccttatgctggctatcagtcttttgctgctgggtggttaaaagctggaaaaggagagtaggctccgcaatttctaggacaaacgacactattggttggcgtgagaacaggcggtatgctcaagatattgagagagcacagtacacgggaggagctccaggggctaaatattcattttatggggttatgattttaggattactgagtagtgcccagagttgctctgagagtgtgatagcagactccaagatcatgcagtgcacaacctcagggagttccaccctttgcaaggcaagtgggacagtaatcatgagattgggacccataggctcagagtcttgcttaattctgaaagggcttaaggacagtgaaaagcagttcatatctataaagaccatatcaagcgagctcacatgccgagaaggagaatctttctggaccaccctatacacacccatctgcttaagctcaagaagatgtcacttgatgggagaatgtgtctctgatcgttgcctcaagtggaagaccaatgaaacatctgcagaattcacagggaaagcacatggtgacgttatgcacgagaacaaatgctttgagcaaagtggaggaataggctacggatgttttaacgtaaacccctcttgtctctatgtccactcttatctcaagtctgtttacaggaacgggttcaaaatcttcaggtgtgtggcatggaatcataggattagactagaggtgacaactcagtcccgaaagttccctatggtattgatggccatgagcacacagcccactgactggggatccattggtttgattcttgactcagaggggataacaggaacaaactcttattcctttatgaagcatggctcaggaagttttgctataatagatgacccatattccccagaacctcgaaaagggttcttgggagaagtgcggtgtccaacagaagagacagccatgcgagcatcaccttcttgcaagatggccccaaacttgattgagtatcagcctgagatggacacagcagagtgcactacaaatatgatagaccctatggctatattcaatcgaggatctctgccacaggttcgggatgggatgacattcacacaatcaattgaaaagaacactgttcaggcattgacaacaggggaagttaaggcatccatccgcctcacattagatgattatgatgtggtgtatcaaaacagccagtctgactgctcagcaacattcaagaacctcactggctgttattcatgtgatgagggatccagactatgctatcaagtaaaggcagagggcgagactgtttttcacttcatcaatgaagaagagtccatcaatgttatcaacaaggtgagcccagacgtgagcgactactgcaccgttctccacttctcaaggcctattatttctattgaggggacatatgactgcgggctaagtaagagaccaatggtgataaaaggtactctgattgccactgctccacatgatgatagaaagcatgaaggaggttcttctcttgtagtcaaccccaaaggtggttcagttgacttctttggatggttgtctgggttgacctcatggctcggtgggcctctgaaaacctttctgactattcttgggttcctagccgtgggcttactgttggtggtgataatcatcattatcattcgaactggaatgcagcaagctttgaagaagaagataaaataa

SEQ ID NO: 4668 - RNA, 4014 nt, synthetic construct
  misc_feature 1..4014: note = derived and/or modified CDS sequence (wt) from TOSV(SI-121283)__JF330279.1__GP
  source 1..4014: mol_type = other RNA
atgtttattgcaaagttgttattaatatcctgtttagtgcagcaggcctatctgaaatacactattatttcagaaatagggaacggcactagaacttctttctgttatagctcaagaaccagtttggggagcctcctggaagcttgggacaacataactgagtctattggtctgacgtctggcacttgtaaagtgggatcactggagaacagagagtgcaaaagagacatcatgtctaattatgttgcagaagtgcattccaacttacatggcttaggagctatgatgcacaactatggtgatgacaagaggattgaggtcctcaatgatgtcatcccagatgagctcaatccaggacgccacaactgcagtgacctagaccggaagccattttggacagagtttattaatgtggcaaaaccagcgaatgaaatggctcctatgtcagttatcccaccaccaattgtgaagcccataccagttgcagaatcaaccactaagaaaaccatcccatttgataaactcctatctgaagcagagaaggagttgaaccaaacaaagatcaggttggaaaccgaaagaagatctaatgcggaagaggctgctaaagaaagggccaggatgagagagattgaagacaagctgagaaaggattgggaactggaacgggagaggaaagatgcagtggcagaggacctagcaaaagaaatagcgaggagaagagaaatagagaggaaagctcatgaattagataagatgctcaagaagaaggagcgtgaagatctggtggccagagaaagggtggatgaggatatgagaaaccatgtacgcagaccaaatacaaccatagcccctacaatcataactactctgctcatgggcagtgcagtaatggcagggcctttggagaacagggaaccaacccacttattaaacaggccagggaatggggcttaccccctaagtgactttgctgagcccacctgcacgctagcttatggctcagagtgcaaatcctgggagcaccaattggacgagctgtcttttcccttcttccactctaaccttgacaagtacagcatgctagaggctgcaacagagacaataccaatactcaacaagagctcagctgtctgcacaatctccccatccacgcattcatcgaatgcatgtggtagggaagccagcctcataaagaagaaatgtggaagtgatatgtcggctttcttctatgttaacctggctggtcagataactgttgtcaaatgtgacacaaaccatgtcttgtctaacgactgtgggaattgtatctcaaaaaccctgagcggccagaagatttacactccagttcaggatatgttctgtcagaaaggctggtcagagtccatcccaagcacaaggtactcaaaagacctctgttctattggcttgcacactgtgaaggaatgtaagattggtaccaccaactttgagagagtgggtttcattgttgtgaagggtcgaaagatgtacattgagcagatgaagatgagatcgaggcaagaattcagcgaagaccagttcttatgctacaaatcagagggcagttctggctcttctgtaaaactaaagaaggttaaggttgagtcatgcaaaggtgttactacatcatcagcctctaagtgctctggggatgaatatttctgcagtaggtacccatgtgagactgcaaatgttgaagctcattgcatcctacgaaggcatagtgcagtcatagaagtgaatgttaatggtgtgtgggttgtgccgagatgcattggttatgaagaggtccttgtcagaaggacttcacttaaagtggaagatacatctagtagagaatgtgatacctgcttatgggaatgcgggaaaaataaactaattgtcaaaactcatggccccaaaatagtttatgcaacagcgtgtagccatgggtcttgcaagagtgtgatgcaaaagccagcgacctttgtgtacctgccatacccaggaaacagcgagattgttggaggtgatataggggtccacatgacagaggaatcatcaccttcgaacatacacatggtggcacactgccctgcgaaggactcctgtgaggttagcagctgcctattctgtgtgcacggactgcttaactaccagtgccacaccttgttctctgcactactaatatccaccactgtgatgtccattcttacactgctacttcttcttgtgaagggagctaaggatcttgttaagagattgttctactggctaattacacccctgtgctggctatcagtattctgtggctggatgatcagaagctggaaaaagagagtgggctcagctatctctaggaccaatgacactattggttggcgtgacaatagtcgacgtgggcaagacattgagagagcacagtacacaggaggagctccaggggctaaatattcattttatggagtgatgatccttggcctattaggtaatgtgcatagctgctctgagagtatcatagccgattccaaaatcatgcaatgtacaacttcgggaagttctaccctctgcaaggctagtgggactgtgattatgaagctagggcctataggctcagagtcctgcctaattctgaagggtcttaaggacagcgaaaagcaatttatctcaattaagaccatatcaagtgagctcacatgccgagagggagagtccttctggactactctatatactcctgtctgtctaagctcgcgaaggtgccacctgatgggagaatgtgtctccgaccgctgcctcagatggaagaccaatgaaacatctgcagaattcactgggaaggcacatggagaagttatgcatgagaataggtgctttgagcagagcggtggaataggctatggatgctttaatgtgaacccttcttgtctctatgtccattcctatctcaaatctgtctacaagaatggatttaagatctttagatgtgtggcatggaaccataggattagacttgaagtcactacccactcccggaaattcccaatggttctgatggccatgagcacacaacccaccgactggggttccattgggttaatcctagattcagaagggataacagggaccaacgcatattcctttatgaagcatgggttaggaagctttgccatcatagatgacccatattccccagagcctcgtaaaggctttttaggagaagtgcgatgtccaacagaagagacagctattcgggcgtcaccctcatgtaagatggctcctaacttgatcgagtaccagcctgaaatggacactgcagagtgcaccacaaacatgatagatcccatggccatattcaatcgagggtccttgccacaagtccgggatggaatgacattcacacaatcaattgagaagaacacagttcaagcactgacaacaggggaggttagagcttccatacgcctcacattggatgactatgatgtggtgtaccaaaatagccagttcgactgctcagctacatttaagaatctcaccggctgttattcatgtgatgagggttccagaatgtgctaccaggtgaaggcagaaggagaaaccatcttccactttgtcaatgaggatgaatccatcaatgtcatcaacaaggtgagcccagacgtaagtgactactgcactgttctccacttctcaagacctgtcatctctattgaagggaggtatgactgcgggcttagcaagaggccaatggtaataaaaggcactctaattgccactgccccgcatgatgataggaagcatgaaggaggctcctcattggttgtcaaccccaaaggcggcacagttgacttcttcggatgggtgtctggactaacctcatggctaggtggacctctgaaaaccttcttgaccatccttggattcctagctctgggcctacttttagtagtgataatcatcatcattgctcgcactggggtcgaacaggccctaaaaaagaaaaacaagtaa

SEQ ID NO: 4669 - RNA, 4014 nt, synthetic construct
  misc_feature 1..4014: note = derived and/or modified CDS sequence (wt) from TOSV(SI-121487)__JF330280.1__GP
  source 1..4014: mol_type = other RNA
atgtttattgcaaagttgttattaatatcctgtttagtgcagcaggcctatctgaaatacactattatttcagaaatagggaacggcactagaacttctttctgttatagctcaagaaccagtttggggagcctcctggaagcttgggacaacataactgagtctattggtctgacgtctggcacttgtaaagtgggatcactggagaacagagagtgcaaaagagacatcatgtctaattatgttgcagaagtgcattccaacttacatggcttaggagctatgatgcacaactatggtgatgacaagaggattgaggtcctcaatgatgtcatcccagatgagctcaatccaggacgccacaactgcagtgacctagaccggaagccattttggacagagtttattaatgtggcaaaaccagcgaatgaaatggctcctatgtcagttatcccaccaccaattgtgaagcccataccagttgcagaatcaaccactaagaaaaccatcccatttgataaactcctatctgaagcagagaaggagttgaaccaaacaaagatcatgttggaaaccgaaagaagatctaatgcggaagaggctgctaaagaaagggccaggatgagagagattgaagacaagctgagaaaggattgggaactggaacgggagaggaaagatgcagtggcagaggacctagcaaaagaaatagcgaggagaagagaaatagagaggaaagctcatgaattagataagatgctcaagaagaaggagcgtgaagatctggtggccagagaaagggtggatgaggatatgagaaaccatgtgcgcagaccaaatacaaccatagcccctacaatcataactactctgctcatggccagtgcagtaatggcaggacctttggagaacagggaaataaaccacttactaaactggcctgggaatggggcttacaccctaagtgactttgctgagtccacctgcacgctagcttatggctcagagtgcaaatcctgggagcaccaattggacgagctgtcttttcccttcttccactctaaccttgacaagtacagcatgctagaggctgcaacagagacaataccaatactcaacaagagctcagctgtctgcacaatctccccatccacgcattcatcgaatgcatgtggtagggaagccagcctcataaagaagaaatgtggaagtgatatgtcggctttcttctatgttaacctggctggtcagataactgttgtcaaatgtgacacaaaccatgtcttgtctaacgactgtgggaattgtatctcaaaaaccctgagcggccagaaaatttacactccagttcaggatatgttctgtcagaaaggctggtcagagtccatcccaagcacaaggtactcaaaagacctctgttctattggcttgcacactgtgaaggaatgtaagattggtaccaccaactttgagagagtgggtttcattgttgtgaagggtcgaaagatgtacattgagcagatgaagatgagatcgaggcaagaattcagcgaagaccagttcttatgctacaaatcagagggcagttctggctcttctgtaaaactaaagaaggttaaggttgagtcatgcaaaggtgttactacatcatcagcctctaagtgctctggggatgaatatttctgcagtaggtacccatgtgagactgcaaatgttgaagcccattgcatcctacgaaggcatagtgcagtcatagaagtgaatgttaatggtgtatgggttgtgccgagatgcattggttatgaagaggtccttgtcagaaggacttcacttaaagtggaagatacatctagtagagaatgtgatacctgcttatgggaatgcgggaaaaataaactaattgtcaaaactcatggccccaaaatagtttatgcaacagcgtgtagccatgggtcttgcaagagtgtgatgcaaaagccagcgaccttcgtgtacctgccatacccaggaaacagcgagattgttggaggtgatataggggtccacatgacagaggaatcatcaccttcaaacatacacatggtggcacactgccctgcgaaggactcctgtgaggttagcagctgcctattctgtgtgcacggactgcttaactaccagtgccacaccttgttctctgcactactaatatccaccactgtgatgtccattcttacactgctacttcttcttgtgaagggagctaaggatcttgttaagagattgttctactggctaatcacacccctgtgctggctatcagtattctgtggctggatgatcagaagctggaaaaagagagtgggctcagctatctctagaaccaatgacactattggttggcgtgacaatagtcgacgtgggcaagacattgagagagcacagtacacaggaggagctccaggggctaaatattcattttatggagtgatgatccttggcctattaggtaatgtgcatagctgctctgagagtatcatagccgattccaaaatcatgcaatgtacaacttcgggaagttctaccctctgcaaggctagtgggactgtgattatgaagctagggcctataggctcagagtcctgcctaattctgaagggtcttaaggacagcgaaaagcaatttatctcaattaagaccatatcaagtgagctcacatgccgagagggagagtccttctggactactctatatactcctgtctgtctaagctcgcgaaggtgccacctgatgggagaatgtgtctccgaccgctgcctcagatggaagaccaatgaaacatctgcagaattcactgggaaggcacatggagaagttatgcatgagaataggtgctttgagcagagcggtggaataggctatggatgctttaatgtgaacccttcttgtctctatgtccattcctatctcaaatctgtctacaagaatggatttaagatctttagatgtgtggcatggaaccataggattagacttgaagtcactacccactcccggaaattcccaatggttctgatggccatgagcacacaacccaccgactggggttccattgggttaatcctagattcagaagggataacagggactaacgcatattcctttatgaagcatgggtcaggaagctttgccatcatagatgacccatattccccagagcctcgtaaaggctttttaggagaagtgcgatgtccaacagaagagacagctattcgggcgtcaccctcatgtaagatggctcctaacttgatcgagtaccagcctgaaatggacactgcagagtgcaccacaaacatgatagatcccatggccatattcaatcgagggtccttgccacaagtccgggatggaatgacattcacacaatcaattgagaagaacacagttcaagcactgacaacaggggaggttagagcttccatacgcctcacattagatgactatgatgtggtgtaccaaaatagccagttcgactgctcagctacatttaagaatctcaccggctgttattcatgtgatgagggttccagaatgtgctaccaggtgaaggcagaaggagaaaccatcttccactttgtcaatgaggatgaatccatcaatgtcatcaacaaggtgagcccagacgtaagtgactactgcactgttctccacttctcaagacctgtcatctctattgaagggaggtatgactgcgggcttagcaaaaggccaatggtaataaaaagcactctaattgccactgccccgcatgatgataggaagcatgaaggaggctcctcattggttgtcaaccccaaaggcggcacagttgacttcttcggatgggtgtctggactaacctcatggctaggtggacctctgaaaaccttcttgaccatccttggattcctagctctgggcctacttttagtagtgataatcatcatcattgctcgcactggggtgcaacaggccctgaaaaagaaaaacaagtaa

SEQ ID NO: 4670 - RNA, 4014 nt, synthetic construct
  misc_feature 1..4014: note = derived and/or modified CDS sequence (wt) from TOSV(SI-21137)__EU003173.1__GP
  source 1..4014: mol_type = other RNA
atgtttattgcaaagttgttattaatttcctgtttagtgcagcaggcctatctgaaatacactattatttcagaaatagggaacggcactagaacttctttttgttatagctcaaggaccagcttggggagcctcctggaagcttgggacaacataactgagtctattggtctgacgtctggcacttgtaaagtgggatcactggagaacagagagtgcaaaagagacatcatgtctaattatgttgcagaagtgcattccaacttacatggcttaggagctatgatgcacaactatggtgatgacaagaggattgaggtcctcaatgatgtcatcccagatgagctcaatccaagacgccacaactgcagtgacctagaccggaagccattttggacagagtttattaatgtggcaaagccagcgaatgaaatagctcctatgtcagttatcccaccaccaattgtgaagcccataccagttgcagaatcaaccactaagaaaaccatcccatttgataaactcctatctgaagcagagaaggagttgaaccaaacaaagatcaggttggaaaccgaaagaagatctaatgcggaagaggctgctaaagaaagggccaggatgagagagattgaagacaagctgagaaaggattgggaactggaacgggagaggaaagatgcagtggcagaggacctagcaaaagaaatagcgaggagaagagaaatagagaggaaagctcatgaattagataagatgctcaagaagaaggagcgtgaagatctggtggccagagaaagggtggatgaggatatgagaaaccatgtacgcagaccaaatacaaccatagcccctacaatcataactactctgctcatggccagtgcagtaatggcaggacctttggagaacagggaaacaaaccacttactaaacaggccagggaatggggcttacaccctaagtgactttgctgagtccacctgcacgctagcttatggctcagagtgcaaatcctgggagcaccaattggacgagctgtcttttcccttcttccactctaaccttgacaagtacagcatgctagaggctgcaacagagacaataccgatactcaacaagagctcagctgtctgcacaatttccccatccacgcattcatcgaatgcatgtggtagggaagccagcctcataaagaagaaatgtggaagcaatatgtcggctttcttctatgttaacctggctggtcagataactgttgtcaagtgtgacacaaaccatgtcttgtctaacgactgtgggaattgtatctcaaaaaccctgagcggccagaagatttacactccagttcaggatatgttctgtcagaaaggctggtcagagaccaacccaagcacaaggtactcaaaagacctctgttctattggcttgcacactgtgaaggaatgtaagattggtaccaccaactttgagagagagggtttcattgttgtgaaggggcgaaagatgtacattgagcagatgaagatgagatcgaggcaagaattcagcgaagaccagttcttatgctacaaatcagagggcagttctggctcttctgtaaaactaaagaaggttaaggttgagtcatgcaaaggtgttactacatcatcagcctctaaatgctctggggatgaatatttctgcagtaggtacccatgtgagactgcaaatgttgaagcccattgcatcctacgaaggcatagtgcagtcatagaagtgaatgttaatggtgtatgggttgtgccgagatgcattggttatgaagaggtccttgtcagaaggacttcacttaaagtggaagatacatctagtagagaatgtgatacctgcttatgggaatgcgggaaaaataaactaattgtcaaaactcatggccccaaaatagtttatgcaacagcgtgtagccatgggtcttgcaagagtgtgatgcaaaagccagcgaccttcgtgtacctgccatacccaggaaacagcgagattgttggaggtgatataggggtccacatgacagaggaatcatcaccttcaaacatacacatggtggcacactgccctgcgaaggactcctgtgaggttagcagctgcctattctgtgtgcacggactgcttaactaccagtgccacaccttgttctctgcactactaatatccaccactgtgatgtccattcttacactgctacttcttcttgtgaagggagctaaggatcttgttaagagattgttctactggctaatcacacccctgtgctggctatcagtattctgtggctggatgatcagaagctggaaaaagagagtgggctcagctatctctagaaccaatgacactattggttggcgtgacaatagtcgacgtgggcaagacattgagagagcacagtacacaggaggagctccaggggctaaatattcattttatggagtgatgatccttggcctattaggtaatgtgcatagctgctctgagagtatcatagccgattccaaaatcatgcaatgtacaacttcgggaagttctaccctctgcaaggctagtgggactgtgattatgaagctagggcctataggctcagagtcctgcctaattctgaagggtcttaaggacagcgaaaagcaatttatctcaattaagaccatatcaagtgagctcacatgccgagagggagagtccttctggactactctatatactcctgtctgtctaagctcgcgaaggtgccacctgatgggagaatgtgtctccgaccgctgcctcagatggaagaccaatgaaacatctgcagaattcactgggaaggcacatggagaagttatgcatgagaataggtgctttgagcagagcggtggaataggctatggatgctttaatgtgaacccttcttgtctctacgtccattcctatctcaaatctgtctacaagaatggatttaagatctttagatgtgtggcatggaaccataggattagacttgaagtcactacccactcccggaaattcccaatggttctgatggccatgagcacacaacccaccgactggggttccattgggttaatcctagattcaggagggataacagggactaacgcatattcctttatgaagcatgggttaggaagctttgccatcatagatgacccatattctccagagcctcgtaaaggctttttaggagaagtgcgatgtccaacagaagagacagctattcgggcgtcaccctcatgtaagatggctcctaacttgatcgagtaccagcctgaaatggacactgcagagtgcaccacaaacatgatagatcccatggccatattcaatcgagggtccttgccacaagtccgggatggaatgacattcacacaatcaattgagaagaacacagttcaagcactgacaacaggggaggttagagcttccatacgcctcacattggatgactatgatgtggtgtaccaaaatagccagttcgactgctcagctacatttaagaatctcaccggctgttattcatgtgatgagggttccagaatgtgctaccaggtgaaggccgaaggagaaaccatcttccactttgtcaatgaggatgaatccatcaatgtcatcaacaaggtgagcccagacgtaagtgactactgcactgttctccacttctcaagacctgtcatctctattgaagggaggtatgactgcgggcttagcaagaggccaatggtaataaaaggcactctaattgccactgccccgcatgatgataggaagcatgaaggaggctcctcattggttgtcaaccccaaaggcggcacagttgacttcttcggatgggtgtctggactaacctcatggctaggtggacctctgaaaaccttcttgaccatccttggattcctagctctgggcctacttttagtagtgataatcatcatcattgctcgcactggggtcgaacaggccctaaaaaagaaaaacaagtaa

SEQ ID NO: 4671 - RNA, 4014 nt, synthetic construct
  misc_feature 1..4014: note = derived and/or modified CDS sequence (wt) from TOSV(SI-31051)__EU003174.1__GP
  source 1..4014: mol_type = other RNA
atgtttattgcaaagttgttattaatttcctgtttagtgcagcaggcctatctgaaatacactattatttcagaaatagggaacggcactagaacttctttttgttatagctcaaggaccagcttggggagcctcctggaagcttgggacaacataactgagtctattggtctgacgtctggcacttgtaaagtgggatcactggagaacagagagtgcaaaagagacatcatgtctaattatgttgcagaagtgcattccaacttacatggcttaggagctatgatgcacaactatggtgatgacaagaggattgaggtcctcaatgatgtcatcccagatgagctcaatccaggacgccacaactgcagtgacctagaccggaagccattttgcacagagtttattaatgtggcaaaaccagcgaatgaaatggctcctatgtcagttatcccaccaccaattgtgaagcccataccagttgcagaaccaaccactaagaaaaccatcccatttgataaactcctatctgaagcagagaaggagttgaaccaaacaaagatcaggttggaaaccgaaagaagatctaatgcggaagaggctgctaaagaaagggccaggatgagagagattgaagacaagctgagaaaggattgggaactggaacgggagaggaaagatgcagtggcagaggacctagcaaaagaaatagcgaggagaagagaaatagagaggaaagctcatgaattggataagatgctcaagaagaaggagcgtgaagatctggtggccagagaaagggtggatgaggatatgagaaaccatgtacgcagaccaaatacaaccatagcccctacaatcataactactctgctcatggccagtgcagtaatggcaggacctttggagaacagggaaacaaaccacttactaaacaggccagggaatggggcttacaccctaagtgactttgctgagtccacctgcacgctagcttatggctcagagtgcaaatcctgggagcaccaattggacgagctgtcttttcccttcttccactctaaccttgacaagtacagcatgctagaggctgcaacagagacaataccaatactcaacaagagctcagctgtctgcacaatctccccatccacgcattcatcgaatgcatgtggtagggaagccagcctcataaagaagaaatgtggaagtgatatgtcggctttcttctatgttaacctggctggtcagataactgttgtcaaatgtgacacaaaccatgtcttgtctaacgactgtgggaattgtatctcaaaaaccctgagcggccagaagatttacactccagttcaggatatgttctgtcagaaaggctggtcagagtccatcccaagcacaaggtactcaaaagacctctgttctattggcttgcacactgtgaaggaatgtaagattggtaccaccaactttgagagagtgggtttcattgttgtgaagggtcgaaagatgtacattgagcagatgaagatgagatcgaggcaagaattcagcgaagaccagttcttatgctacaaatcagagggcagttctggctcttctgtaaaactaaagaaggttaaggttgagtcatgcaaaggtgttactacatcatcagcctctaagtgctctggggatgaatatttctgcagtaggtacccatgtgagactgcaaatgttgaagcccattgcatcctacgaaggcatagtgcagtcatagaagtgaatgttaatggtgtatgggttgtgccgagatgcattggttatgaagaggtccttgtcagaaggacttcacttaaagtggaagatacatctagtagagaatgtgatacctgcttatgggaatgcgggaaaaataaactaattgtcaaaactcatggccccaaaatagtttatgcaacagcgtgtagccatgggtcttgcaagagtgtgatgcaaaagccagcgaccttcgtgtacctgccatacccaggaaacagcgagattgttggaggtgatataggggtccacatgacagaggaatcatcaccttcaaacatacacatggtggcacactgccctgcgaaggactcctgtgaggttagcagctgcctattctgtgtgcacggactgcttaactaccagtgccacaccttgttctctgcactactaatatccaccactgtgatgtccattcttacactgctacttcttcttgtgaagggagctaaggatcttgttaagagattgttctactggctaatcacacccctgtgctggctatcagtattctgtggctggatgatcagaagctggaaaaagagagtgggctcagctatctctagaacaaatgacactattggttggcgtgacaatagtcgacgtgggcaagacattgagagagcacagtacacaggaggagctccaggggctaaatattcattttatggagtgatgatccttggcctattaggtaatgtgcatagctgctctgagagtatcatagccgattccaaaatcatgcaatgtacaacttcgggaagttctaccctctgcaaggctagtgggactgtgattatgaagctagggcctataggctcagagtcctgcctaattctgaagggtcttaaggacagcgaaaagcaatttatctcaattaagaccatatcaagtgagctcacatgccgagagggagagtccttctggactactctatatactcctgtctgtctaagctcgcgaaggtgccacctgatgggagaatgtgtctccgaccgctgcctcagatggaagaccaatgaaacatctgcagaattcactgggaaggcacatggagaagttatgcatgagaataggtgctttgagcagagcggtggaataggctatggatgctttaatgtgaacccttcttgtctctacgtccattcctatctcaaatctgtctacaagaatggatttaagatctttagatgtgtggcatggaaccataggattagacttgaagtcactacccactcccggaaattcccaatggttctgatggccatgagcacacaacccaccgactggggttccattgggttaatcctagattcaggagggataacagggactaacgcatattcctttatgaagcatgggttaggaagctttgccatcatagatgacccatattccccagagcctcgtaaaggctttttaggagaagtgcgatgtccaacagaagagacagctattcgggcgtcaccctcatgtaagatggctcctaacttgatcgagtaccagcctgaaatggacactgcagagtgcaccacaaacatgatagatcccatggccatattcaatcgagggtccttgccacaagtccgggatggaatgacattcacacaatcaattgagaagaacacagttcaagcactgacaacaggggaggttagagcttccatacgcctcacattggatgactatgatgtggtgtaccaaaatagccagttcgactgctcagctacatttaagaatctcaccggctgttattcatgtgatgagggttccagaatgtgctaccaggtgaaggccgaaggagaaaccatcttccactttgtcaatgaggatgaatccatcaatgtcatcaacaaggtgagcccagacgtaagtgactactgcactgttctccacttctcaagacctgtcatctctattgaagggaggtatgactgcgggcttagcaagaggccaatggtaataaaaggcactctaattgccactgccccgcatgatgataggaagcatgaaggaggctcctcattggttgtcaaccccaaaggcggcacagttgacttcttcggatgggtgtctggactaacctcatggctaggtggacctctgaaaaccttcttgaccatccttggattcctagctctgggcctacttttagtagtgataatcatcatcattgctcgcactggggtcgaacaggccctaaaaaagaaaaacaagtaa

SEQ ID NO: 4672 - RNA, 4014 nt, synthetic construct
  misc_feature 1..4014: note = derived and/or modified CDS sequence (wt) from TOSV(SI-39538)__EU003175.1__GP
  source 1..4014: mol_type = other RNA
atgtttattgcaaagttgttattaatttcctgtttagtgcagcaggcctatctgaaatacactattatttcagaaatagggaacggcactagaacttctttttgttatagctcaaggaccagcttggggagcctcctggaagcttgggacaacataactgagtctattggtctgacgtctggcacttgtaaagtgggatcactggagaacagagagtgcaaaagagacatcatgtctaattatgttgcagaagtgcattccaacttacatggcttaggagctatgatgcacaactatggtgatgacaagaggattgaggtcctcaatgatgtcatcccagatgagctcaatccaggacgccacaactgcagtgacctagaccggaagccattttggacagagtttattaatgtggcaaaaccagcgaatgaaatggctcctatgtcagttatcccaccaccaattgtgaagcccataccagttgcagaatcaaccactaagaaaaccatcccatttgataaactcctatctgaagcagagaaggagttgaaccaaacaaagatcaggttggaaaccgaaagaagatctaatgcggaagaggctgctaaagaaagggccaggatgagagagattgaagacaagctgagaaaggattgggaactggaacgggagaggaaagatgcagtggcagaggacctagcaaaagaaatagcgaggagaagagaaatagagaggaaagctcatgaattagataagatgctcaagaagaaggagcgtgaagatctggtggccagagaaagggtggatgaggatatgagaaaccatgtacgcagaccaaatacaaccatagcccctacaatcataactactctgctcatggccagtgcagtaatggcaggacctttggagaacagggaaacaaaccacttactaaacaggccagggaatggggcttacaccctaagtgactttgctgagtccacctgcacgctagcttatggctcagagtgcaaatcctgggagcaccaattggacgagctgtcttttcccttcttccactctaaccttgacaagtacagcatgttagaggctgcaacagagacaataccaatactcaacaagagctcagctgtctgcacaatctccccatccacgcattcatcgaatgcatgtggtagggaagccagcctcataaagaagaaatgtggaagtgatatgtcggctttcttctatgttaacctggctggtcagataactgttgtcaaatgtgacacaaaccatgtcttgtctaacgactgtgggaattgtatctcaaaaaccctgagcggccagaagatttacactccagttcaggatatgttctgtcagaaaggctggtcagagtccatcccaagcacaaggtactcaaaagacctctgttctattggcttgcacactgtgaaggaatgtaagattggtaccaccaactttgagagagtgggtttcattgttgtgaagggtcgaaagatgtacattgagcagatgaagatgagatcgaggcaagaattcagcgaagaccagttcttatgctacaaatcagagggcagttctggctcttctgtaaaactaaagaaggttaaggttgagtcatgcaaaggtgttactacatcatcagcctctaagtgctctggggatgaatatttctgcagtaggtacccatgtgagactgcaaatgttgaagcccattgcatcctacgaaggcatagtgcagtcatagaagtgaatgttaatggtgtatgggttgtgccgagatgcattggttatgaagaggtccttgtcagaaggacttcacttaaagtggaagatacatctagtagagaatgtgatacctgcttatgggaatgcgggaaaaataaactaattgtcaaaactcatggccccaaaatagtttatgcaacagcgtgtagccatgggtcttgcaagagtgtgatgcaaaagccagcgaccttcgtgtacctgccatacccaggaaacagcgagattgttggaggtgatataggggtccacatgacagaggaatcatcaccttcaaacatacacatggtggcacactgccctgcgaaggactcctgtgaggttagcagctgcctattctgtgtgcacggactgcttaactaccagtgccacaccttgttctctgcactactaatatccaccactgtgatgtccattcttacactgctacttcttcttgtgaagggagctaaggatcttgttaagagattgttctactggctaatcacacccctgtgctggctatcagtattctgtggctggatgatcagaagctggaaaaagagagtgggctcagctatctctagaaccaatgacactattggttggcgtgacaatagtcgacgtgggcaagacattgagagagcacagtacacaggaggagctccaggggctaaatattcattttatggagtgatgatccttggcctattaggtaatgtgcatagctgctctgagagtatcatagccgattccaaaatcatgcaatgtacaacttcgggaagttctaccctctgcaaggctagtgggactgtgattatgaagctagggcctataggctcagagtcctgcctaattctgaagggtcttaaggacagcgaaaagcaatttatctcaattaagaccatatcaagtgagctcacatgccgagagggagagtccttctggactactctatatactcctgtctgtctaagctcgcgaaggtgccacctgatgggagaatgtgtctccgaccgctgcctcagatggaagaccaatgaaacatctgcagaattcactgggaaggcacatggagaagttatgcatgagaataggtgctttgagcagagcggtggaataggctatggatgctttaatgtgaacccttcttgtctctacgtccattcctatctcaaatctgtctacaagaatggatttaagatctttagatgtgtggcatggaaccataggattagacatgaagtcactacccactcccggaaattcccaatggttctgatggctatgagcacacaacccaccgactggggttccattgggttaatcctagattcaggagggataacagggactaacgcatattcctttatgaagcatgggttaggaagctttgccatcatagatgacccatattccccagagcctcgtaaaggctttttaggagaagtgcgatgtccaacagaagagacagctattcgggcgtcaccctcatgtaagatggctcctaacttgatcgagtaccagcctgaaatggacactgcagagtgcaccacaaacatgatagatcccatggccatattcaatcgagggtccttgccacaagtccgggatggaatgacattcacacaatcaattgagaagaacacagttcaagcactgacaacaggggaggttagagcttccatacgcctcacattggatgactatgatgtggtgtaccaaaatagccagttcgactgctcagctacatttaagaatctcaccggctgttattcatgtgatgagggttccagaatgtgctaccaggtgaaggccgaaggagaaaccatcttccactttgtcaatgaggatgaatccatcaatgtcatcaacaaggtgagcccagacgtaagtgactactgcactgttctccacttctcaagacctgtcatctctattgaagggaggtatgactgcgggcttagcaagaggccaatggtaataaaaggcactctaattgccactgccccgcatgatgataggaagcatgaaggaggctcctcattggttgtcaaccccaaaggcggcacagttgacttcttcggatgggtgtctggactaacctcatggctaggtggacctctgaaaaccttcttgaccatccttggattcctagctctgggcctacttttagtagtgataatcatcatcattgctcgcactggggtcgaacaggccctaaaaaagaaaaacaagtaa

SEQ ID NO: 4673 - RNA, 4014 nt, synthetic construct
  misc_feature 1..4014: note = derived and/or modified CDS sequence (wt) from TOSV(SI-40463)__EU003176.1__GP
  source 1..4014: mol_type = other RNA
atgtttattgcaaagttgttattaatttcctgtttagtgcagcaggcctatctgaaatacactattatttcagaaatagggaacggcactagaacttctttttgttatagctcaaggaccagcttggggagcctcctggaagcttgggacaacataactgagtctattggtctgacgtctggcacttgtaaagtgggatcactggagaacagagagtgcaaaagagacatcatgtctaattatgttgcagaagtgcattccaacttacatggcttaggagctatgatgcacaactatggtgatgacaagagggttgaggttctcaatgatgtcatcccagatgagctcaatccaggacgccacaactgcagtgacctagaccggaagccattttggacagagtttattaatgtggcaaaaccagtgaatgaaatggctcctatgtcagttatcccaccaccaattgtgaagcccataccagttgcagaatcaaccactaagaaaaccatcccatttgataaactcctatctgaagcagagaaggagttgaaccaaacaaagatcaggttggaaaccgaaagaagatctaatgcggaagaggctgctaaagaaagggccaggatgagagagattgaagacaagctgagaaaggattgggaactggaacgggagaggaaagatgcagtggcagaggacctagcaaaagaaatagcgaggagaagagaaattgagaggaaagctcatgaattagataagatgctcaagaagaaggagcgtgaagatctggtggccagagaaagggtggatgaggatatgagaaaccatgtacgcagaccaaatacaaccatagcccctacaatcataactactctgctcatggccagtgcagtaatggcaggacctttggagaacagggaaacaaaccacttactaaacaggccagggaatggggcttacaccctaagtgactttgctgagtccacctgcacgctagcttatggctcagagtgcaaatcctgggagcaccaattggacgagctgtcttttcccttcttccactctaaccttgacaagtacagcatgctagaggctgcaacagagacaataccaatactcaacaagagctcagctgtctgcacaatctccccatccacgcattcatcgaatgcatgtggtagggaagccagcctcataaagaagaaatgtggaagtgatatgtcggctttcttctatgttaacctggctggtcagataactgttgtcaaatgtgacacaaaccatgtcttgtctaacgactgtgggaattgtatctcaaaaaccctgagcggccagaagatttacactccagttcaggatatgttctgtcagaaaggctggtcagagtccatcccaagtacaaggtactcaaaagacctctgttctattggcttgcacactgtgaaggaatgtaagattggtaccaccaactttgagagagtgggtttcattgttgtgaagggtcgaaagatgtacattgagcagatgaagatgagatcgaggcaagaattcagcgaagaccagttcttatgctacaaatcagagggcagttctggctcttctgtaaaactaaagaaggttaaggttgagtcatgcaaaggtgttactacatcatcagcctctaagtgctctggggatgaatatttctgcagtaggtacccatgtgagactgcaaatgttgaagcccattgcatcctacgaaggcatagtgcagtcatagaagtgaatgttaatggtgtatgggttgtgccgagatgcattggttatgaagaggtccttgtcagaaggacttcacttaaagtggaagatacatctagtagagaatgtgatacctgcttatgggaatgcgggaaaaataaactaattgtcaaaactcatggccccaaaatagtttatgcaacagcgtgtagccatgggtcttgcaagagtgtgatgcaaaagccagcgaccttcgtgtacctgccatacccaggaaacagcgagattgttggaggtgatataggggtccacatgacagaggaatcatcaccttcaaacatacacatggtggcacactgccctgcgaaggactcctgtgaggttagcagctgcctattctgtgtgcacggactgcttaactaccagtgccacaccttgttctctgcactactaatatccaccactgtgatgtccattcttacactgctacttcttcttgtgaagggagctaaggatcttgttaagagattgttctactggctaatcacacccctgtgctggctatcagtattctgtggctggatgatcagaagctggaaaaagagagtgggctcagctatctctagaaccaatgacactattggttggcgtgacaatagtcgacgtgggcaagacattgagagagcacagtacacaggaggagctccaggggctaaatattcattttatggagtgatgatccttggcctattaggtaatgtgcatagctgctctgagagtatcatagccgattccaaaatcatgcaatgtacaacttcgggaagttctaccctctgcaaggctagtgggactgtgattatgaagctagggcctataggctcagagtcctgcctaattctgaagggtcttaaggacagcgaaaagcaatttatctcaattaagaccatatcaagtgagctcacatgccgagagggagagtccttctggactactctatatactcctgtctgtctaagctcgcgaaggtgccacctgatgggagaatgtgtctccgaccgctgcctcagatggaagaccaatgaaacatctgcagaattcactgggaaggcacatggagaagttatgcatgagaataggtgctttgagcagagcggtggaataggctatggatgctttaatgtgaacccttcttgtctctacgtccattcctatctcaaatctgtctacaagaatggatttaagatctttagatgtgtggcatggaaccataggattagacttgaagtcactacccactcccggaaattcccaatggttctgatggccatgagcacacaacccaccgactggggttccattgggttaatcctagattcaggagggataacagggactaacgcatattcctttatgaagcatgggttaggaagctttgccatcatagatgacccatattccccagagcctcgtaaaggctttttaggagaagtgcgatgtccaacagaagagacagctattcgggcgtcaccctcatgtaagatggctcctaacttgatcgagtaccagcctgaaatggacactgcagagtgcaccacaaacatgatagatcccatggccatattcaatcgagggtccttgccacaagtccgggatggaatgacattcacacaatcaattgagaagaacacagttcaagcactgacaacaggggaggttagagcttccatacgcctcacattggatgactatgatgtggtgtaccaaaatagccagttcgactgctcagctacatttaagaatctcaccggctgttattcatgtgatgagggttccagaatgtgctaccaggtgaaggccgaaggagaaaccatcttccactttgtcaatgaggatgaatccatcaatgtcatcaacaaggtgagcccagacgtaagtgactactgcactgttctccacttctcaagacctgtcatctctattgaagggaggtatgactgcgggcttagcaagaggccaatggtaataaaaggcactctaattgccactgccccgcatgatgataggaagcatgaaggaggctcctcattggttgtcaaccccaaaggcggcacagttgacttcttcggatgggtgtctggactaacctcatggctaggtggacctctgaaaaccttcttgaccatccttggattcctagctctgggcctacttttagtagtgataatcatcatcattgctcgcactggggtcgaacaggccctaaaaaagaaaaacaagtaa

SEQ ID NO: 4674 - RNA, 4020 nt, synthetic construct
  misc_feature 1..4020: note = derived and/or modified CDS sequence (wt) from TOSV(SI-40614)__EU003177.1__GP
  source 1..4020: mol_type = other RNA
atgtttattgcaaagttgttattaatttcctgtttagtgcagcaggcctatctgaaatacactattatttcagaaatagggaacggcactagaacttctttttgttatagctcaaggaccagcttggggagcctcctggaagcttgggacaacataactgagtctattggtctgacatctggcacttgtaaagtgggatcactggaaaacagggattgcaaaagagacatcatgtcaaattatgttgcagaagtgcattccaacttacatggcctaggagctatgatgcacaactatggtgatgacaagagggttgaggtcctcaatgatgtcatcccagatgagctcaatccaggacgccacaactgcagtgacctggaccggaaaccattttggacagagtttattaatgtggcaaagccagcaaacaaaatagctcctatatcagtgatcccaccaccaattgtgaagcccataccaattgcagaatcaactatcaagaagaccatcccatttgataaactcctatctgaagcagaaaaggagttgaaccaaacaaaaatcagattggaaaccgaaagaaggtctaatgcgggagaggctgcaagagaaagggccaggatgagagaaattgaagacaagctgagaaagaattgggagctagaacgggagagaaaagatgcagtggcagacgacctggcaaaagaaatagcgagaagaagagagatagagagaaaagctcatgaattagataagatgctcaagaagaaggagcgtgaagatcaggtggcaatagaaagggtgagtgaggatatgagaaaccatgtgcgtagaccaaatacaaccatagcccctgctcccacgatcattaccaccctgctcatggccagtgcggtaatggcaggacctttggagaacagggaaacaaaccacttactaaacaggccagggaatggagcttataccctaagtgactttgctgagtccacctgcacgctagcttatggctcagagtgcaaatcctgggagcaccaattggatgagctgtcttttcccttcttccactctaaccttgacaagtacagcatgctagaggctgcaacagagacaataccgatactcaacaagagctcagctgtctgcacaatttccccatccacgcattcatcaaatgcatgtggcagggaagctagcctcataaagaagaaatgtggaaacaatatgtctgctttcttctatgttaacctagccggccagataactgttgtcaagtgtgatacaaaccatgttttgtctaacgactgtgggaattgtatctcaaaaaccttgagcggtcagaagatttatactccagttcaggatatgttctgtcagagaggctggacggagtccatcccaagcacaaggtactcaaaagacctctgttctattggcttgcacactgtgaaggaatgcaagactggtgccaccaactttgagagagtaggtttcattgtcgtgaagagtcgaaagatgtacatagagcagatgaagatgagatcaagacaagaattcagcgaagaccagttcttatgctacaaatcagagagcagttctggctcttctgtaaaattaaagaaggtcaaggttgagtcatgcaaaggtgttacaacatcatcagcctccaagtgctctggggatgaatatttctgcagcaggtacccatgtgaaactgcaaatgttgaagctcattgcattttacgaaggcatagtgcagttatagaagtgaatgtcaatggcgtgtgggttgtgccgagatgcattggttatgaagaggttcttgttagaaggacttcactcaaaatggaagatacatctagtagagaatgtgatacctgcttatgggaatgcggaaaaaataaactaattgtcaaaactcatggccccaaaatagtttatgcaacagcatgtagccatgggtcttgcaagagtgtgatgcaaaagccagcgaccttcgtgtacctaccgtacccaggaaacagcgagattgttggaggtgatataggggtccacatgacagaggaatcatcaccctcaaacatacacatggtggcacactgccctgcgaaggattcctgtgaggttagcagctgcctattctgtgtgcacggactgcttaattaccagtgccacaccttgttctctgcactactaatatccactactgtgatgtccattcttacattgctacttcttcttgtgaagggggctaaagatcttgtcaagaaattattctactggctaattacacccctgtgctggctatcagtgttctgtggctggatgatcaaaagctggaaaaagagagtgggctcagctatttctagaaccaatgacaccattggttggcgtgacaatagacgatatgggcgagacgttgagagagcacagtacacaggaggagttccaggggccatctattcattttatggcgtgatgatccttggcctattaggtaatgtgcatagttgctctgagagtgtcatagccgactccaaagtcatgcaatgcacaacttcgggaagttctaccctctgcaaggctagtgggactgtgattatgaagctagggcctataggctcagagtcctgcctgattttgaagggtcttaaggacaatgaaaagcaattcatctcaatcaagacaatatcaagtgaactcacatgccgagagggagagtccttctggactactctatatactcctgtctgtctaagttcgcgaaggtgccacctaatgggagaatgtgtctccgaccgctgcctcaaatggaaaaccaatgaaacatctccagaattcactgggaaggcacatggagaagttatgcatgagaatagatgctttgagcagagcggtggaataggctacggatgctttaatgtgaacccttcttgtctctacgtccactccattctcaaatctgtctacaagaatggattcaagatctttagatgtgtggcatggaaccacaggattagacttgaagttactacccactcccggaaattcccaatggttttgatggctatgagcacacaacccactgactggggttctattgggttaatcctagattcagaagggataacagggactaacgcgtattccttcatgaagcacgggtcaggaagctttgccattatagatgatccatattccccagagcctcgtaaaggctttttaggagaagtgcgatgtccaacagaagagacagctattcgggcgtcaccctcatgtaagatggctcctaacttgattgagtaccagcctgagatggacactgcagagtgcactacaaacatgatagatcccatggccatattcaatcgagggtccttgccacaagttcgggatggaatgacattcacacaatcaattgagaagaacacagttcaagcactgacaacaggggaggttagagcttccatacgccttacattggacgactatgatgtggtgtatcagaatagccagtccgactgctcagctacatttaagaatctcaccggctgttattcatgtgatgagggttcaagaatgtgctaccaggtgaaggcagaaggagaaactatctttcactttgtcaatgaggatgaatctatcaatgttattaacaaggtgagcccagacgtaagtgactactgcactgttctccacttctcaagacctgttatctctattgaagggaggtatgactgcgggcttagcaaaagaccaatggtaataaaaggtactctaattgctactgccccgcatgatgacaggaagcatgaaggaggttcctcattggttgtcaaccccaaaggcggcacagttgacttcttcgggtgggtgtctggactaacctcatggctaggtgggcctctgaaaaccttcttgaccatccttggattcctagctctgggcctacttttagtagtgataatcatcatcattgctcgcactggggtcgaacaggccctaaaaaagaaaaacaagtaa

SEQ ID NO: 4675 - RNA, 4014 nt, synthetic construct
  misc_feature 1..4014: note = derived and/or modified CDS sequence (wt) from TOSV(SI-51903)__EU003178.1__GP
  source 1..4014: mol_type = other RNA
atgtttattgcaaagttgttattaatttcctgtttagtgcagcaggcctatctgaaatacactattatttcagaaatagggaacggcactagaacttctttttgttatagctcaaggaccagcttggggagcctcctggaagcttgggacaacataactgagtctattggtctgacgtctggcacttgtaaagtgggatcactggagaacagagagtgcaaaagagacatcatgtctaattatgttgcagaagtgcattccaacttacatggcttaggagctatgatgcacaactatggtgatgacaagaggattgaggtcctcaatgatgtcatcccagatgagctcaatccaggacgccacaactgcagtgacctagaccggaagccattttggacagagtttattaatgtggcaaagccagcgaatgaaatagctcctatgtcagttatcccaccaccaattgtgaagccaataccagttgcagaatcaaccactaagaaaaccatcccatttgataaactcctatctgaagcagagaaggagttgaaccaaacaaagatcaggttggaaaccgaaagaagatctaatgcggaagaggctgctaaagaaagggccaggatgagagagattgaagacaagctgagaaaggattgggaactggaacgggagaagaaagatgcagtggcagaggacctagcaaaagaaatagcgaggagaagagaaatagagaggaaagctcatgaattagataagatgctcaagaagaaggagcgtgaagatctggtggccagagaaagggtggatgaggatatgagaaaccatgtacgcagaccaaatgcaaccatagcccctacaatcataactactctgctcatggccagtgcagtaatggcaggacctctggagaacagggaaacaaaccacttactaaacaggccagggaatggggcttacaccctaagtgactttgctgagtccacctgcacgctagcttatggctcagagtgcaaatcctgggagcaccaattggacgagctgtcttttcccttcttccactctaaccttgacaagtacagcatgctagaggctgcaacagagacaataccgatactcaacaagagctcagctgtctgcacaatctccccatccacgcattcatcgaatgcatgtggtagggaagccagcctcataaagaagaaatgtggaagtgatatgtcggctttcttctatgttaacctggctggtcagataactgttgtcaaatgtgacacaaaccatgtcttgtctaacgactgtgggaattgtatctcaaaaaccctgagcggccagaagatttacactccagttcaggatatgttctgtcagaaaggctggtcagagtccatcccaagcacaaggtactcaaaagacctctgttctattggcttgcacactgtgaaggaatgtaagattggtaccaccaactttgagagagtgggtttcattgttgtgaagggtcgaaagatgtacattgagcagatgaagatgagatcgaggcaagaattcagcgaagacgagttcttatgctacaaatcagagggcagttctggctcttctgtaaaactaaagaaggttaaggttgagtcatgcaaaggtgttactacatcatcagcctctaagtgctctggggatgaatatttctgcagtaggtacccgtgtgagactgcaaatgttgaggcccattgcatcctacgaaggcatagtgcagtcatagaagtgaatgttaatggtgtatgggttgtgccgagatgcattggttatgaagaggtccttgtaagaaggacttcacttaaagtggaagatacatctagtagagaatgtgatacctgcttatgggaatgcgggaaaaataaactaattgtcaaaactcatggccccaaaatagtttatgcaacagcgtgtagccatgggtcttgcaagagtgtgatgcaaaagccagcgaccttcgtgtacctgccatacccaggaaacagcgagattgttggaggtgatataggggtccacatgacagaggaatcatcaccctcaaacatacacatggtggcacactgccctgcgaaggactcctgtgaggttagcagctgcctattctgtgtgcacggactgcttaactaccagtgccacaccttgttctctgcactactaatatccaccactgtgatgtccattcttacactgctacttcttcttgtgaagggagctaaggatcttgttaagagattgttctactggctaatcacacccctgtgctggctatcagtattctgtggctggatgatcagaagctggaaaaagagagtgggctcagctatttctagaaccaatgacactattggttggcgtgacaatagtcgacgtgggcaagacgttgagagagcacagtacacaggaggagctccaggggctaaatattcattttatggagtgatgatccttggcctattaggtaatgtgcatagctgctctgagagtatcatagccgattccaaaatcatgcaatgtacaacttcgggaagttctaccctctgcaaggctagtgggactgtgattatgaagctagggcctataggctcagagtcctgcctaattctgaagggtcttaaggacagcgaaaagcaatttatctcaattaagaccatatcaagtgagctcacatgccgagagggagagtccttctggactactctatatactcctgtctgtctaagctcgcgaaggtgccacctgatgggagaatgtgtctccgaccgctgcctcagatggaagaccaatgaaacatctgcagaattcactgggaaggcacatggagaagttatgcatgagaataggtgctttgagcagagcggtggaataggctatggatgctttaatgtgaacccttcttgtctctacgtccattcctatctcaaatctgtctacaagaatggatttaagatctttagatgtgtggcatggaaccataggattagacttgaagtcactacccactcccggaaattcccaatggttctgatggccatgagcacacaacccaccgactggggttccattgggttaatcctagattcaggagggataacagggactaacgcatattcctttatgaagcatgggttaggaagctttgccatcatagatgacccatattccccagagcctcgtaaaggctttttaggagaagtgcgatgtccaacagaagagacagctattcgggcgtcaccctcatgtaagatggctcctaacttgatcgagtaccagcctgaaatggacactgcagagtgcaccacaaacatgatagatcccatggccatattcaatcgagggtccttgccacaagtccgggatggaatgacattcacacaatcaattgagaagaacacagttcaagcactgacaacaggggaggttagagcttccatacgcctcacattggatgactatgatgtggtgtaccaaaatagccagttcgactgctcagctacatttaagaatctcaccggctgttattcatgtgatgagggtcccagaatgtgctaccaggtgaaggccgaaggagaaaccatcttccactttgtcaatgaggatgaatccatcaatgtcatcaacaaggtgagcccagacgtaagtgactactgcactgttctccacttctcaagacctgtcatctctattgaagggaggtatgactgcgggcttagcaaaaggccaatggtaataaaaggcactctaattgccactgccccgcatgatgataggaagcatgaaggaggctcctcattggttgtcaaccccaaaggcggcacagttgacttcttcggatgggtgtctggactaacctcatggctaggtggacctctgaaaaccttcttgaccatccttggattcctagctctgggcctacttttagtagtgataatcatcatcattgctcgcactggggtcgaacaggccctaaaaaagaaaaacaagtaa

SEQ ID NO: 4676 - RNA, 4014 nt, synthetic construct
  misc_feature 1..4014: note = derived and/or modified CDS sequence (wt) from TOSV(SI-68809)__EU003179.1__GP
  source 1..4014: mol_type = other RNA
atgtttattgcaaagttgttattaatttcctgtttagtgcagcaggcctatctgaaatacactattatttcagaaatagggaacggcactagaacttctttttgttatagctcaaggaccagcttggggagcctcctggaagcttgggacaacataactgagtctattggtctgacgtctggcacttgtaaagtgggatcactggagaacagagagtgcaaaagagacatcatgtctaattatgttgcagaagtgcattccaacttacatggcttaggagctatgatgcacaactatggtgatgacaagaggattgaggtcctcaatgatgtcatcccagatgagcttaatccaggacgccacaactgcagtgacctagaccggaagccattttggacagagtttattgatgtggcaaagccagcgaatgaaatagctcctatgtcagttatcccaccaccaattgtgaagcctataccagttgcagaatcaaccattaagaaaaccatcccatttgataaactcctatctgaagcagaggaggagttgaaccaaacaaagatcaggttggaaaccgaaagaagatctaatgcggaagaggctgctaaagaaagggccaggatgagagagattgaagacaagctgagaaaggattgggagctggaacgggagaggaaagatgcagtggcagaggacctagcaaaagaaatagcgagaagaagagaaatagagaggaaagctcatgaattagataagatgctcaaaaagaaggagcgtgaggatctggtggccagagaaagggtgaatgaggatatgaggaaccatgtgcgcagaccaaatacaaccatagcccctacaatcataactactctgctcatggccagtgcagtaatggcaggacctttggagaacagggagacaaaccacttactaaacaggccagggaatggggcttacaccctaagtgactttgctgagtccacctgcacgctagcttatggctcagagtgcaaatcctgggagcaccaattggatgagctgtcttttcccttcttccactctaaccttgacaagtacagcatgttagaggctgcaacagagacaataccgatactcaacaagagttcagctgtctgcacaatttccccatccacgcattcatcaaatgcatgtggcagggaagctagcctcataaagaagaaatgtggaagcaatatgtcggctttcttctatgttaacctggctggtcagataactgttgtcaagtgtgacacaaaccatgtcttgtctaacgactgtgggaattgtatctcaaaaaccctgagcggccagaagatttacactccagttcaggatatgttctgtcagaaaggctggtcagagtccatcccaagcacaaggtactcaaaagacctctgttctattggcttgcacactgtgaaggaatgcaagactggtaccaccaactttgagagagtgggtttcattgttgtgaagggtcgaaagatgtacattgagcagatgaagatgagatcgaggcaagaattcagcgaagaccagttcttatgctacaaatcagagggcagttctggctcttctgtaaaactaaagaaggttaaggttgagtcatgcaaaggtgttacaacatcatcagcctctaagtgctctggggatgaatatttctgcagtaggtacccatgtgagactgcaaatgttgaggcccattgcatcctacgaaggcatagtgcagtcatagaagtgaatgttaatggtgtatgggttgtgccgaggtgcattggttatgaagaggtccttgtcagaaggacttcactcaaagtggaagatacatctagtagagaatgtgatacctgcttatgggaatgcgggaaaaataaactaattgtcaaaactcatggccccaaaatagtttatgcaacagcgtgtagccatgggtcttgcaagagtgtgatgcaaaagccagcgaccttcgtgtacctgccatacccaggaaacagcgagattgttggaggtgatataggggtccacatgacagaggaatcatcaccttcaaacatacacatggtggcacactgccctgcgaaggactcctgtgaggttagcagctgcctattctgtgtgcacggactgcttaactaccagtgccacaccttgttctctgcactactaatatccaccactgtgatgtccattcttacactgctacttcttcttgtgaagggagctaaggatcttgttaagagattgttctactggctaatcacacccctgtgctggctatcagtattctgtggctggatgatcagaagctggaaaaggagagtgggctcagctatttctagaaccaatgacactattggttggcgtgacaatagtcgacgtgggcaagacgttgagagagcacagtacacaggaggagctccaggggctaaatattcattttatggagtgatgatccttggcctattaggtgaggtgcatagctgctctgagagtatcatagccgattccaaaatcatgcaatgcacaacttcgggaagttctaccctctgcaaggctagtgggactgtgattatgaagctagggcctataggctcagagtcctgcctgattctgaagggtcttaaggacagcgaaaagcaatttatctcaattaagaccatatcaagtgagctcacatgccgagagggagagtccttctggactactctatatactcctgtctgtctaagctcgcgaaggtgccacctgatgggagaatgtgtctccgaccgctgcctcaaatggaagaccaatgaaacatctgcagaattcactgggaaggcacatggagaagttatgcatgagaatagatgctttgagcagagcggtggaataggctatggatgctttaatgtgaacccttcttgtctctacgtccattcctatctcaaatctgtctacaagaatggatttaagatctttagatgtgtggcatggaaccataggattagacttgaagtcactacccactcccggaaattcccaatggttctgatggccatgagcacacaacccaccgactggggttccattgggttaatcctggattcaggagggataacagggactaacgcatattcctttatgaagcatgggttaggaagctttgccatcatagatgacccatattccccagagcctcgcaaaggctttttaggagaagtgcgatgtccaacagaagagacagctattcgggcgtcaccctcatgtaagatggcccctaacttgatcgagtaccagcctgaaatggacactgcagagtgcaccacaaatatgatagatcccatggccatattcaatcgagggtccttgccacaagtccgggatggaatgacattcacacaatcaattgagaagaacacagttcaagcactgacaacaggggaggttagagcttccatacgcctcacattggatgactatgatgtggtgtaccaaaatagccagttcgactgctcagctacatttaagaatctcaccggctgttactcatgtgatgagggttccagaatgtgctaccaggtgaaggccgaaggagaaaccatcttccactttgtcaatgaggatgaatccatcaatgtcatcaacaaggtgagcccagacgtaagtgactactgcactgttctccacttctcaagacctgtcatctctattgaagggaggtatgactgcgggcttagcaaaaggccaatggtaataaaaggcactctaattgccactgccccgcatgatgataggaagcatgaaggaggctcctcattggttgtcaaccccaaaggcggcacagttgacttcttcggatgggtgtctggactaacctcatggctaggtggacctctgaaaaccttcttgaccatccttggattcctagctctgggcctacttttagtagtgataatcatcatcattgctcgcactggggtcgaacaggccctaaaaaagaaaaacaagtaa

SEQ ID NO: 4677 - RNA, 4014 nt, synthetic construct
  misc_feature 1..4014: note = derived and/or modified CDS sequence (wt) from TOSV(SI-76082)__EU003180.1__GP
  source 1..4014: mol_type = other RNA
atgtttattgcaaagttgttattaatttcctgtttagtgcagcaggcctatctgaaatacactattatttcagaaatagggaacggcactagaacttctttttgttatagctcaaggaccagcttggggagcctcctggaagcttgggacaacataactgagtctattggtctgacgtctggcacttgtaaagtgggatcactggagaacagagagtgcaaaagagacatcatgtctaattatgttgcagaagtgcattccaacttacatggcttaggagctatgatgcacaactatggtgatgacaagaggattgaggtcctcaatgatgtcatcccagatgagctcaatccaggacgccacaactgcagtgacctagaccggaagccattttggacagagtttattaatgtggcaaaaccagcgaatgaaatggctcctatgtcagttatcccaccaccaattgtgaagcccataccagttgcagaatcaaccactaagaaaaccatcccatttgatgaactcctatctgaagcagagaaggagttgaaccaaacaaagatcaggttggaaaccgaaagaagatctaatgcggaagaggctgctaaagaaagggccaggatgagagagattgaagacaagctgagaaaggattgggaactggaacgggagaggaaagatgcagtggcagaggacctagcaaaagaaatagcgaggagaagagaaatagagaggaaagctcatgaattagataagatgctcaagaagaaggagcgtgaagatctggtggccagagaaagggtggatgaggatatgagaaaccatgtacgcagaccaaatacaaccatagcccctacaatcataactactctgctcatggccagtgcagtaatggcaggacctttggagaacagggaaacaaaccacttactaaacaggccagggaatggggcttacaccctaagtgactttgctgagtccacctgcacgctagcttatggctcagagtgcaaatcctgggagcaccaattggacgagctgtcttttcccttcttccactctaaccttgacaagtacagcatgctagaggctgcaacagagacaataccaatactcaacaagagctcagctgtctgcacaatctccccatccacgcattcatcaaatgcatgtggcagggaagctagcctcataaagaagaaatgtggaagtgatatgtcggctttcttctatgttaacctggctggtcagataactgttgtcaaatgtgacacaaaccatgtcttgtctaacgactgtgggaattgtatctcaaaaaccctgagcggccagaagatttacactccagttcaggatatgttctgtcagaaaggctggtcagagtccatcccaagcacaaggtactcaaaagacctctgttctattggcttgcacactgtgaaggaatgtaagattggtaccaccaactttgagagagtgggtttcattgttgtgaagggtcgaaagatgtacattgagcagatgaagatgagatcgaggcaagaattcagcgaagaccagttcttatgctacaaatcagagggcagttctggctcttctgtaaaactaaagaaggttaaggttgagtcatgcaaaggtgttactacatcatcagcctctaagtgctctggggatgaatatttctgcagtaggtacccatgtgagactgcaaatgttgaggcccattgcatcctacgaaggcatagtgcagtcatagaagtgaatgttaatggtgtatgggttgtgccgagatgcattggttatgaagaggtccttgtcagaaggacttcacttaaagtggaagatacatctagtagagaatgtgatacctgcttatgggaatgcgggaaaaataaactaattgtcaaaactcatggccccaaaatagtttatgcaacagcgtgtagccatgggtcttgcaagagtgtgatgcaaaagccagcgaccttcgtgtacctgccatacccaggaaacagcgagattgttggaggtgatataggggtccacatgacagaggaatcatcaccttcaaacatacacatggtggcacactgccctgcgaaggactcctgtgaggttagcagctgcctattctgtgtgcacggactgcttaactaccagtgccacaccttgttctctgcactactaatatccaccactgtgatgtccattcttacactgctacttcttcttgtgaagggagctaaggatcttgttaagagattgttctactggctaatgacacccctgtgctggctatcagtattctgtggctggatgatcagaagctggaaaaagagagtgggctcagctatctctagaaccaatgacactattggttggcgtgacaatagtcgacgtgggcaagacgttgagagagcacagtacacaggaggagctccaggggctaaatattcattttatggagtgatgatccttggcctattaggtaatgtgcatagctgctctgagagtatcatagccgattccaaaatcatgcaatgtacaacttcgggaagttctaccctctgcaaggctagtgggactgtgattatgaagctagggcctataggctcagagtcctgcctaattctgaagggtcttaaggacagcgaaaagcaatttatctcaattaagaccatatcaagtgagctcacatgccgagagggagagtccttctggactactctatatactcctgtctgtctaagctcgcgaaggtgccacctgatgggagaatgtgtctccgaccgctgcctcagatggaagaccaatgaaacatctgcagaattcactgggaaggcacatggagaagttatgcatgagaataggtgctttgagcagagcggtggaataggctatggatgctttaatgtgaacccttcttgtctctatgtccattcctatctcaaatctgtctacaagaatggatttaagatctttagatgtgtggcatggaaccataggattagacttgaagtcactacccactcccggaaattcccaatggttctgatggccatgagcacacaacccaccgactggggttccattgggttaatcctagattcaggagggataacagggactaacgcatattcctttatgaagcatgggttaggaagctttgccatcatagatgacccatattccccagagcctcgtaaaggctttttaggagaagtgcgatgtccaacagaagagacagctattcgggcgtcaccctcatgtaagatggctcctaacttgatcgagtaccagcctgaaatggacactgcagagtgcaccacaaacatgatagatcccatggccatattcaatcgagggtccttgccacaagtccgggatggaatgacattcacacaatcaattgagaagaacacagttcaagcactgacaacaggggaggttagagcttccatacgcctcacattggatgactatgatgtggtgtaccaaaatagccagttcgactgctcagctacatttaagaatctcaccggctgttattcatgtgatgagggttccagaatgtgctaccaggtgaaggccgaaggagaaaccatcttccactttgtcaatgaggatgaatccatcaatgtcatcaacaaggtgagcccagacgtaagtgactactgcactgttctccacttctcaagacctgtcatctctattgaagggaggtatgactgcgggcttagcaagaggccaatggtaataaaaggcactctaattgccactgccccgcatgatgataggaagcatgaaggaggctcctcattggttgtcaaccccaaaggcggcacagttgacttcttcggatgggtgtctggactaacctcatggctaggtggacctctgaaaaccttcttgaccatccttggattcctagctctgggcctacttttagtagtgataatcatcatcattgctcgcactggggtcgaacaggccctaaaaaagaaaaacaagtaa

SEQ ID NO: 4678 - RNA, 4020 nt, synthetic construct
  misc_feature 1..4020: note = derived and/or modified CDS sequence (wt) from TOSV(TOSV/Mantova.ITA/2013)__KM507329.1__GP
  source 1..4020: mol_type = other RNA
atgtttattgcaaagttgttattaatttcctgtttagtgcagcaggcctatctgaaatacactattatttcagaaatagggaacggcactagaacttctttttgttatagctcaaggaccagcttggggagcctcctggaagcttgggacaacataactgagtctattggtctgacatctggcacttgtaaagtgggatcactggaaaacagggattgcaaaagagacatcatgtcaaattatgttgcagaagtgcattccaacttacatggcctaggagctatgatgcacaactatggtgatgacaagagggttgaggtcctcaatgatgtcatcccagatgagctcaatccaggacgccacaactgcagtgacctggaccggaaaccattttggacagagtttattaatgtggcaaagccagcaaacaaaatagctcctatatcagtgatcccaccaccaattgtgaagcccataccaattgcagaatcaactatcaaggaaaccatcccatttgaaaaactcctatctgaagcagaaaaggagttgaaccaaacaaaaatcagattggaaaccgaaagaaggtctaatgcggaagaggctgcaagagaaagggccagggtgagagaaattgaagacaagctgagaaagaattgggagctagaacgggagagaaaagatgcagtggcagacgacctggcaaaagaaatagcgagaagaagagagatagagagaaaagctcatgaactagataagatgctcaagaagaaggagcgtgaagatcaggtggcaatagaaagggtgagtgaggatatgagaaaccatgtgcgtagaccaaatacaaccatagcccctgctcccacgatcattaccaccctgctcatggccagtgcggtaatggcaggacctttggagaacagggaaacaaaccacttactaaacaggccagggaatggagcttataccctaagtgactttgctgagtccacctgcacgctagcttatggctcagagtgcaaatcctgggagcaccaactggatgagctgtcttttcccttcttccactctaaccttgacaagtacagcatgctagaggctgcaacagagacaataccgatactcaacaagagctcagctgtctgcacaatttccccatccacgcattcatcaaatgcatgtggcagggaagctagccttataaagaagaaatgtggaaacaatatgtctgctttcttctatgttaacctagccggccagataactgttgtcaagtgtgatacaaaccatgttttgtctaacgactgtgggaattgtttctcaaaaaccttgagcggtcagaagatttatactccagttcaggatatgttctgtcagagaggctggacggagtccatcccaagcacaaggtactcaaaagacctctgttctattggcttgcacactgtgaaggaatgcaagactggtaccaccaactttgagagagtaggtttcattgtcgtgaagagtcgaaagatgtacatagagcagatgaagatgagatcaagacaagaattcagcgaagaccagttcttatgctacaaatcagagagcagttctggctcttctgtaaaattaaagaaggtcaaggttgagtcttgcaaaggtgttacaacatcatcagcctctaagtgctctggggatgaatatttctgcagcaggtacccatgtgaaactgcaaatgttgaagctcattgcattttacgaaggcatagtgcagttatagaagtgaatgtcaatggcgtgtgggttgtgccgagatgcattggttatgaagaggttcttgttagaaggacttcactcaaaatggaagatacatctagtagagaatgtgatacctgcttatgggaatgcggaaaaaataaactaattgtcaaaactcatggccccaaaatagtttatgcaacagcatgtagccatgggtcttgcaagagtgtgatgcaaaagccagcgaccttcgtgtacctaccgtacccaggaaacagcgagattgttggaggtgatataggggtccacatgacagaggaatcatcaccttcaaatatacacatggtggcacactgccctgcgaaggattcctgtgaggttagcagctgcctattctgtgtgcacggactgcttaattaccagtgccacaccttgttctctgcactactaatatccactactgtgatgtccattctcacattgctacttcttcttgtgaagggggctaaagatcttgtcaagaaattattctactggctaattacacccctgtgctggttatcagtgttctgtggctggatgatcaaaagctggaaaaagagagtgggctcagctatttctagaaccaatgacaccattggttggcgtgacaatagacgatatgggcgagacgttgagagagcacagtacacaggaggagctccaggggctaaatattcattttatggagtgatgatccttggcctattaggtaatgtgcatagttgctctgagagtgtcatagccgactccaaagtcatgcaatgcacaacttcgggaagttctaccctctgcaaggctagtgggactgtgattatgaagctagggcctataggctcagagtcctgcctgattttgaagggtcttaaggacaatgaaaagcaattcatctcaatcaagacaatatcaagtgaactcacatgccgagagggagagtccttctggactactctatatacccctgtctgtctaagttcgcgaaggtgccacctaatgggagaatgtgtctccgaccgctgcctcaaatggaaaaccaatgaaacatctgcagaattcactgggaaggcacatggagaagttatgcatgagaatagatgctttgagcagagcggtggaataggctatggatgctttaatgtgaacccttcttgtctctacgtccattcttatctcaaatctgtctacaagaatggattcaagatctttagatgtgtggcatggaaccacaggattagacttgaagttactacccactcccggaaattcccaatggttttgatggctatgagcacacaacccactgactggggttctattgggttaatcctagattcagaagggataacagggactaacgcgtattccttcatgaagcacgggtcaggaagctttgccattatagatgacccatattccccagagcctcgtaaaggctttttaggagaagtgcgatgtccaacagaagagacagctattcgggcgtcaccctcatgtaagatggctcctaacttgattgagtaccagcctgagatggacactgcagagtgcactacaaacatgatagatcccatggccatattcaatcgagggtccttgccacaagttcgggatggaatgacattcacacaatcaattgagaagaacacagttcaagcactgacaacaggggaggttagagcttccatacgtcttacattggacgactatgatgtggtgtatcagaatagccagtccgactgctcagctacatttaagaatctcaccggctgttattcatgtgatgagggttcaagaatgtgctaccaggtgaaggcagaaggagaaactatctttcactttgtcaatgaggatgaatctatcaatgttattaacaaggtgagcccagacgtaagtgactactgcactgttctccacttctcaagacctgtcatctctattgaagggaggtatgactgcgggcttagcaaaagaccaatggtaataaaaggtactctaattgctactgctccgcatgatgacaggaagcatgaaggaggttcctcattggttgtcaaccccaaaggcggcacagttgacttcttcgggtgggtgtctggactaacctcatggctaggtgggcctctgaaaaccttcttgaccatccttggattcctagctctgggcctacttttagtagtgataatcatcatcattgctcgcactggggtgcaacaggccctaaaaaagaaaaacaagtaa

SEQ ID NO: 4679 - RNA, 4020 nt, synthetic construct
  misc_feature 1..4020: note = derived and/or modified CDS sequence (wt) from TOSV(TOSV/Phl.233/FR/2009)__HQ184337.1__GP
  source 1..4020: mol_type = other RNA
atgtttattgcaaagttgttattaatttcctgtttagtgcagcaggcctatctgaaatatactattatttcagagacagggaacggcactagaacttccttttgctacagttcaagaactagcttggggagcctcttagaagcttgggacaacgtgactgagtcaattggcctgacttctggcacttgcaaagtggggtcactggagaacagggactgcaggaaagacataatgtccaactacgttgctgaggtgcactctaacctgcacgggctgggagctatgatgcacaactacggtgatgacaagagggttgagatcctcaatgatgtcataccagatgagctcaatcctggacaccacaactgtagtgaccttgaccgaaagccattttggactgagtttattaatgtggcaaagccattgagtgaaatagtcccaatgtcagtgattccaccaccagttgtgaagccccagccacctgcagaaccatcctccaagaaacatgttccgtttgatgtacttttgtcagaagctgagaaggagctaaaccagacaaagattagactggaagatgagagaaagtccaatgcagaagagacagcaaaggagagggctaggatgaaggagattgaggatgaattgagaagggagtgggagctggaacggaagaggaaggacgcaatggcagatgatttagcaaaagaaacagcaagaaggagggagatagaaaggaaggcccatgagcttgataaaatgcttaaaaagaaggagcgcgaaagcctgattgcaaaagagaaagcagatgaggacatgagaagccatgtgcataaaccaaacacgactagagccccagcacccacaattatcaccactctgctcatggcgagtgcagccctagcgggacccctggagaacagggagacaaatcatttgctcaacaggccaggaaatggggcttacactctaagcgactttgctgaatcaacctgcacattggcctatggatcagaatgcaaatcttgggagcaccttctgaatgaggagctgttccccttcttccattctaatcttgacaagtacagcatgctagaagctgcaacagagacagtacctatactcaataagagctctgcagtttgcaccatctctccttccacacattcatcgaatgcctgtgggagagaggctagtgtcattaggaagaaatgttatagtaacatgtcagccttcttctacattaacctggcaggtcaaattactgtgattaagtgtgaaacaaaccacgtcctttctagtgattgtggaaattgcatctctaagagcttgagtggccaaaaggtatacaccccagtgcaagatgtgttctgtcagaagggctggacacagtccatcccaagcacaagatattcaaaagacatctgttctattggtttgcacaccgtgaaggaatgcaagataggaaccactagctttgagagggtgggtttcatagttgtgaaaggccgcaagatgtacattgagcagatgaagatgagatcaaggcaggaatacagcgaagatcaatttttgtgctataaatcagaaagcggctctggctcatctgtcaagctaaagaagttcaaggttcaatcatgcaagggtgttactacatcatcagcctctaagtgctctggcgatgagtatttctgcagcaggtatccatgtgaaacagccaacgttgaagcccactgcattctaaggaggcatagtgcaatagtggaagtgaatgtcaacggcgtgtgggttgtgcctaggtgtattggctatgaggaggttctggtcaaaaggacatcactcaaggttgaagatacgacaggaagggaatgtgattcctgcttatgggaatgtgggaagaataagctgattgtcaagactcatggtcccaaagtggtttatgcaacagcatgcagccatggatcctgtaaaagtgtgatgcagaagccagcaacctttgtgtacctaccataccctggaaatagtgaaattgttgggggtgacatagggattcacatgacagaagagtcatcaccctcgaatatacacttagtagcacactgccctgcaagggactcatgtgatgtcagtgactgtctattctgcgttcacggactccttaattatcagtgccacaccttgttttcagcattgctcatatcaactactgtgatgtcaattctcacattgctgctcttgcttgtgaaaggggcaaaggatcttgttaagaaattgttccactggctgatcactcctttatgctggctatcagtcttttgctgctgggtggttaaaagctggaaaagaagagtgggttcagcaatttctaggacaaacgacactattggttggcgtgaaaacaggcggcatgctcaagacattgagagagcacagtacacaggaggggctccaggggccaaatattcattttatggggttatgattctaggattactgagtagtgcccagagttgctctgaaagtgtgatagcagactccaagatcatgcaatgcacaacctcagggagttccaccctttgcaaggcaagcgggacagtaatcatgagattgggacccataggctcagagtcttgtttgattctgaaagggctcaaggacagtgaaaagcagttcatatctatcaagaccatatcaagtgaactcacgtgccgagaaggagaatctttctggaccaccctatacacacctatctgcttaagctcaagaagatgtcacttgatgggagaatgtgtctctgatcgctgcctcaagtggaagactaatcaaacatccgcagaattcacagggaaagcacatggtgacgttatgcacgagaacagatgctttgagcaaagtggaggaataggctacggatgttttaacgtaaacccttcttgtctctatgtccactcttatctcaagtctgtttacaggaacgggttcaaagttttcaggtgtgtggcatggaatcataggattagactagaggtgacgacacactcccgaaagttccctatggttttgatggccatgagcacacagcccactgactggggatccattggtttgattcttgactcagaagggataacaggaacaaattcttattcctttatgaaacatggctcaggaagttttgctataatagatgacccatattctccagagcctcgaaaagggttcctgggagaagtgcggtgtcctacagaagagacagccatgcgagcatcaccttcttgcaagatggctccaaacttgattgagtatcagcctgaaatggacacagcagagtgtaccacaaatatgatagaccctatggctatattcaatcgaggatctctgccacaggttcgggatgggatgactttcacgcaatcaatagaaaagaacactgttcaggcattaacaacaggggaagttaaggcatccatccgcctcacattagatgattatgatgtggtgtatcaaaatagccagtctgactgctcagccacattcaagaacctcactggttgttactcatgtgatgaaggatccagactatgctatcaagtgaaggcagaaggcgagactatttttcactttattaatgaagaagagtccatcaatgtcatcaataaggtaagcccgggagtgagcgactactgcaccgttctccatttctcaaggcctgttatttctattgagggaacatatgactgcgggctaagcaagagaccaatggtgataaaaggtactctaattgccactgctccacatgatgatagaaagcatgaaggaggttcttctttagtagtcaaccccaaaggtggttcagttgacttctttggatggttgtctggattgacctcatggctcggaggtcctctcaaaacatttctgactattcttggattcctagctgtgggcttactgttggtggtgataattatcatcatcattcggactggaatgcaacaagctttgaagaagaagataaaataa

SEQ ID NO: 4680 - RNA, 4020 nt, synthetic construct
  misc_feature 1..4020: note = derived and/or modified CDS sequence (wt) from TOSV(TOSV/Phl.51/FR/2009)__HQ184336.1__GP
  source 1..4020: mol_type = other RNA
atgtttattgcaaagttgttattaatttcctgtttagtgcagcaggcctatctgaaatatactattatttcagagatagggaacggcactagaacttccttttgctacagttcaagaactagcttggggagcctcttagaagcttgggacaacgtgactgagtcaattggcctgacttctggcacttgcaaagtggggtcactggagaacagggactgcaggaaagacataatgtccaactacgttgctgaggtgcactctaacctgcacgggctgggagctatgatgcacaactacggtgatgacaagagggttgagatcctcaatgatgtcataccagatgagctcaatcctggacaccacaactgtagtgaccttgaccgaaagccattttggactgagtttattaatgtggcaaagccattgagtgaaatagtcccaatgtcagtgattccaccaccagttgtgaagctccagccacctgcagaaccatcctccaagaaacatgttccgtttgatgtacttttgtcagaagctgagaaggagctaaaccagacaaaaattagactggaagatgagagaaagtccaatgcagaagagacagcaaaggagagggctaggatgaaggagattgaggatgaattgagaagggagtgggagctggaacggaagaggaaggacgcaatggcagatgatttagcaaaagaaacagcaagaaggagggagatagataggaaggcccatgagcttgatagaatgcttaaaaagaaggagcgcgaaagcctgattgcaaaagagaaagcagatgagaacatgagaagccatgtgcatgaaccaaacacgactagagccccagcacccacaattatcaccactctgctcatggcaagtgcagccctagcgggacccctggagaacagggagacaaatcatttgctcaacaggccaggaaatggggcttacactctaagcgactttgctgaatcaacctgcacactggcctatggatcagaatgcaaatcttgggagcaccttctgaatgaggagctgttccccttcttccattctaatcttgacaagtacagcatgctagaagctgcaacagagacagtacctatactcaataagagctctgcagtttgcaccatttctccttccacacattcatcgaatgcctgtgggagagaggctagtgtcattaggaagaaatgttatagtaacatgtcagccttcttctacattaacctggcaggtcaaattactgtggttaagtgtgaaacaaaccacgtcctttctagtgattgtggaaattgcatctctaagagcttgagtggccaaaaggtatacaccccagtgcaagatgtgttctgtcagaagggctggacacagtccatcccaagcacaagatattcaaaagacatctgttctattggtttgcacaccgtgaaggaatgcaagataggaaccactagctttgagagggtgggtttcatagttgtgaaaggccgcaagatgtacattgagcagatgaagatgagatcaaggcaggaatacagcgaagatcaatttttgtgctataaatcagaaagcggctctggctcatctgtcaagctaaagaagttcaaggttgaatcatgcaagggtgttactacatcatcagcctctaagtgctctggcgatgagtatttctgcagcaggtttccatgtgaaacagccaacgttgaagcccactgcattctaaggaggcatagtgcaatagtggaagtgaatgtcaacggcgtgtgggttgtgcctaggtgtattggctatgaggaggttctggtcaaaaggacatcactcaaggttgaagatacgacagaaagggaatgtgattcctgcttatgggaatgtgggaagaataagctgattgtcaagactcatggtcccaaagtggtttatgcaacagcatgcagccatggatcctgtaaaagtgtgatgcagaagccagcaacctttgtgtacctaccataccctggaaatagtgaaattgttgggggtgacatagggattcacatgacagaagagtcatcaccctcgaatatacacttagtagcacactgccctgcaagggactcatgtgatgtcagtgactgtctattctgcgttcacggactccttaattatcagtgccacaccttgttttcagcattgctcatatcaactactgtgatgtcaattctcacattgctgctcttgcttgtgaaaggggcaaaggatcttgttaagaaattgttccactggctgatcactcctttatgctggctatcagtcttttgctgctgggtggttaaaagctggaaaagaagagtgggttcagcaatttctaggacaaacgacactattggttggcgtgaaaacaggcggcatgctcaagacattgagagagcacagtacacaggaggggctccaggggccaaatattcattttttggggttatgattctaggattactgagtagtgcccagagttgctctgaaagtgtgatagcagactccaagatcatgcaatgcacaacctcagggagttccaccctttgcaaggcaagcgggacagtaatcatgagattgggacccataggctcagagtcttgtttgattctgaaagggctcaaggacagtgaaaagcagttcatatctatcaagaccatatcaagtgaactcacgtgccgagaaggagaatctttctggaccaccctatacacacctatctgcttaagctcaagaagatgtcacttgatgggagaatgtgtctctgatcgatgcctcaagtggaagactaatcaaacatccgcagaattcacagggaaagcacatggtgacgtcatgcacgagaacagatgctttgagcaaagtggaggaataggctacggatgttttaacgtaaacccttcttgtctctatgtccactcttatctcaagtctgtttacaggaacgggttcaaagttttcaggtgtgtggcatggaatcataggattagactagaggtgacgacacactcccgaaagttccctatggttttgatggccatgagcacacagcccactgactggggatccattggtttgattcttgactcagaagggataacaggaacaaattcttattcctttatgaaacatggctcaggaagttttgctataatagatgacccatattctccagagcctcgaaaagggttcctgggagaagtgcggtgtcctacagaagagacagccatgcgagcatcaccttcttgcaagatggctccaaacttggttgagtatcagcctgaaatggacacagcagagtgtaccacaaatatgatagaccctatggctatattcaatcgaggatctctgccacaggttcgggatgggatgactttcacgcaatcaatagaaaagaacactgttcaggcattaacaacaggggaagttaaggcatccatccgcctcacattagatgattatgatgtggtgtatcaaaatagccagtctgactgctcagccacatttaagaacctcactggttgttactcatgtgatgaaggatccagactatgctatcaagtgaaggcagaaggcgagactatttttcactttattaatgaagaagagtccatcaatgtcatcaataaggtaagcccgagagtgagcgactactgcaccgttctccatttctcaaggcctgttatttctattgagggaacatatgactgcgggctaagcaagagaccaatggtgataaaaggtactctaattgccactgctccacatgatgatagaaagcatgaaggaggttcttctttagtagtcaaccccaaaggtggttcagttgacttctttggatggttgtctggattgacctcatggctcggaggtcctctcaaaacatttctgactattcttggattcctagctgtgggcttactgttggtggtgataattatcatcatcattcggactggaatgcaacaagctttgaagaagaagataaaataa

SEQ ID NO: 4681 - RNA, 4020 nt, synthetic construct
  misc_feature 1..4020: note = derived and/or modified CDS sequence (wt) from TOSV(11368)__KU925897.1__GP
  source 1..4020: mol_type = other RNA
atgtttattgcaaagttgttattaatttcctgtttagtgcagcaggcctatctgaaatatactattatttcagagacagggaacggcactagaacttccttttgctacagttcaagaactagcttggggagcctcttagaagcttgggacaacgtgactgagtcaattggcctgacttctggcacttgcaaagtggggtcactggagaacagggactgcaggaaagacataatgtccaactacgttgctgaggtgcactctaacctgcacgggctgggagctatgatgcacaactacggtgatgacaagagggttgagatcctcaatgatgtcataccagatgagctcaatcctggacaccacaactgtagtgaccttgaccgaaagccattttggactgagtttattaatgtggcaaagccattgagtgaaatggtcccaatgtcagtgattccaccaccagttgtgaagctccagccacctgcagaaccatcctccaagaaacatgttccgtttgatgtacttttgtcagaagctgagaaggagctaaaccagacaaagattagactggaagatgagagaaagtccaatacagaagagacagcaaaggagagggccaggatgaaggagattgaggatgaattgagaagggagtgggagctggaacggaagaggaaggacgcaatggcagatgatttagcaaaagaaacagcaagaaggagggagatagaaaggaaggcccatgagcttgataaaatgcttaaaaagaaggagcgcgaaagcctgattgcaaaagagaaagcagatgaggacatgagaagccatgtgcataaaccaaacacgactagagccctagcacccacaattatcaccactctgctcatggcgagtgcagccctagcgggacccctggagaacagggagacaaatcatttgctcaacaggccaggaaatggggcttacactctaagcgactttgctgaatcaacctgcacactggcctatggatcagaatgcaaatcttgggagcaccttctgaatgaggagctgttccccttcttccattctaatcttgacaagtacagcatgctagaagctgcaacagagacagtacctatactcaataagagctctgcagtttgcaccatttctccttccacacattcatcgaatgcctgtgggagagaggctagtgtcattaggaagaaatgttatagtaacatgtcagccttcttctacattaacctggcaggtcaaattactgtgattaagtgtgaaacaaaccacgtcctttctagtgattgtggaaattgcatctctaagagcttgagtggccaaaaggtatacaccccagtgcaagatgtgttctgtcagaagggctggacacagtccatcccaagcacaagatattcaaaagacatctgttctattggtttgcacaccgtgaaggaatgcaagataggaaccactagctttgagagggtgggtttcatagttgtgaaaggccgcaagatgtacattgagcagatgaagatgagatcaaggcaggaatacagcgaagatcaatttttgtgctataaatcagaaagcggctctggctcatctgtcaagctaaagaagttcaaggttcaatcatgcaagggtgttactacatcatcagcctctaagtgctctggcgatgagtatttctgcagcaggtatccatgtgaaacagccaacgttgaagcccactgcattctaaggaggcatagtgcaatagtggaagtgaatgtcaacggcgtgtgggttgtgcctaggtgtattggctatgaggaggttctggtcaaaaggacatcactcaaggttgaagatacgacaggaagggaatgtgattcctgcttatgggaatgtgggaagaataagctgattgtcaagactcatggtcccaaagtggtttatgcaacagcatgcagccatggatcctgtaaaagtgtgatgcagaagccagcaacctttgtgtacctaccataccctggaaatagtgaaattgttgggggtgacatagggattcacatgacagaagagtcatcaccctcgaatatacacttagtagcacactgccctgcaagggactcatgtgatgtcagtgactgtctattctgcgttcacggactccttaattatcagtgccacaccttgttttcagcattgctcatatcaactactgtgatgtcaattctcacattgctgctcttgcttgtgaaaggggcaaaggatcttgttaagaaattgttccactggctgatcactcctttatgctggctatcagttttttgctgctgggtggttaaaagctggaaaagaagagtgggttcagcaatttctaggacaaacgacactattggttggcgtgaaaacaggcggcatgctcaagacattgagagagcacagtacacaggaggggctccaggggccaaatattcattttatggggttatgattctaggattactgagtagtgcccagagttgctctgaaagtgtgatagcagactccaagatcatgcaatgcacaacctcagggagttccaccctttgcaaggcaagcgggacagtaatcatgagattgggacccataggctcagagtcttgtttgattctgaaagggctcaaggacagtgaaaagcagttcatatctatcaagaccatatcaagtgaactcacatgccgagaaggagaatctttctggaccaccctatacacacctatctgcttaagctcaagaagatgtcacttgatgggagaatgtgtctctgatcgctgcctcaagtggaagactaatcaaacatccgcagaattcacagggaaagcacatggtgacgttatgcacgagaacagatgctttgagcaaagtggaggaataggctacggatgttttaacgtaaacccttcttgtctctatgtccactcttatctcaagtctgtttacaggaacgggttcaaagttttcaggtgtgtggcatggaatcataggattagactagaggtgacgacacactcccgaaagttccctatggttttgatggccatgagcacacagcccactgactggggatccattggtttgattcttgactcagaagggataacaggaacaaattcttattcctttatgaaacatggctcaggaagttttgctataatagatgacccatattctccagagcctcgaaaagggttcctgggagaagtgcggtgtcctacagaagagacagccatgcgagcatcaccttcttgcaagatggctccaaacctgattgagtatcagcctgaaatggacacagcagagtgtaccacaaatatgatagaccctatggctatattcaatcgaggatctctgccacaggttcgggatgggatgactttcacgcaatcaatagaaaagaacactgttcaggcattaacaacaggggaagttaaggcatccatccgcctcatattagatgattatgatgtggtgtatcaaaatagccagtctgactgctcagccacattcaagaacctcactggttgttactcatgtgatgaaggatccagactatgctatcaagtgaaggcagaaggcgagactatttttcactttattaatgaagaagagtccatcaatgtcatcaataaggtaagcccgggagtgagcgactactgcaccgttctccatttctcaaggcctgttatttctattgagggaacatatgactgcgggctaagcaagagaccaatggtgataaaaggtactctaattgccactgctccacatgatgatagaaagcatgaaggaggttcttctttagtagtcaaccccaaaggtggttcagttgacttctttggatggttgtctggattgacctcatggctcggaggtcctctcaaaacatttctgactattcttggattcctagctgtgggcttactgttggtggtgataattatcatcatcattcggactggaatgcaacaagctttgaagaagaagataaaataa

SEQ ID NO: 4682 - RNA, 4020 nt, synthetic construct
  misc_feature 1..4020: note = derived and/or modified CDS sequence (wt) from TOSV(5904242804)__KU935737.1__GP
  source 1..4020: mol_type = other RNA
atgtttattgcaaagttgttattaatttcctgtttagtgcagcaggcctatctgaaatacactattatttcagagatagggaacggcactagaacttctttttgttatagctcaagaactagtttggggagcctcctggaagcttgggacaacataactgagtctattggtctgacgtctggcacttgtaaagtgggatcactggagaacagggattgcaaaagagacatcatgtcaaattatgttgcagaagtgcattccaacttacatggcctaggagctatgatgcacaactatggtgatgacaagagggttgaggtcctcaatgatgtcatcccagatgagctcaatccaggacgtcacaactgcagtgacctagaccggaagccattttggacagagttcattgatgtggcgaagccaacgaacaaaatagctcctatgtcagtgatcccaccaccaattgtgaaacccataccagttgcagaatcaaccattaagaaaagcatcccatttgataaactcttatctgaagcagaaaaggagttgaaccaaactaaaatcagattggaaaccgaaagaaggtctaatgcagaagaagctgcaaaagaaagggccaggatgagggaaattgaagacaagctgagaaaggactgggagctggaacgggagagaaaagatgcagtggcagacgacctggcaaaagaaatagcgagaagaagagagatagagagaaaagctcatgaattagataagatgctcaagaagaaggagcgtgaagatctggtggcaagagaaagggtgagtgaggatatgagaaaccatgtgcgtaaaccaaatacaaccatagcccctgctcccacaatcattactaccctgctcatggccagtgcagtaatggcaggacctttggagaacagggaaacaaaccacttactaaacaggccagggaatggagcttacaccctaagtgactttgctgagtccacctgcacgctagcttatggctcagagtgcaaatcctgggagcaccaactggatgagctgtcttttcccttcttccactctaaccttgacaagtacagcatgctggaggctgcaacagagacaataccgatactcaacaagagctcagctgtctgcacaatttccccatccacgcactcatcgaatgcatgtggtagggaagccagcctcataaagaagaaatgtggaagcaatatgtcggctttcttttatgttaacctagccggtcagataactgttgtcaagtgtgatacaaaccatgtcttgtctaacgactgtgggaattgtatctcaaaaaccttgagcggccagaagatttatactccagttcaggatatgttctgtcagaagggttggacagagtccatcccaaacacaaggtactcaaaagacctctgttctattggcctgcatactgtgaaagaatgcaagactggtaccaccaactttgagagagtgggtttcattgttgtggagggtcggaagatgtacattgagcagatgaagatgagatcgaggcaagaattcagcgaagaccagttcttatgctacaaatcagagagcagttccggctcttctgtgaaactaaagaaggtcaaggttgagtcatgcaaaggtgtcacaacatcatcagcctctaagtgctctggggatgaatatttctgcagcaggtacccatgtgaaactgcaaatgttgaagcccactgcattcttcgaaggcatagtgcagttatagaagtgaatgtcaatggtgtatggattgtgccgagatgcattggttatgaagaggttcttgtcagaaggacttcattaaaagttgaagatacgtcaagtagagaatgtgatacctgcttatgggaatgcgggaaaaataaactaattgttaaaactcatggccctaaaatagtttatgcaacagcatgtagccatgggtcttgcaaaagtgtgatgcaaaagccagcaaccttcgtgtacttgccgtacccaggaaacagcgagattgttggaggtgatataggggtccacatgacagaggaatcatcaccttcaaacatacacatggtggcacactgccctgcaaaggattcttgtgaggttagcagctgcctattctgtgtgcacggactgcttaattaccagtgccacaccttgttctctgcattactaatatccaccactgtgatgtccattcttacactgctacttcttcttgtgaagggagctaaagatcttgtcaagagattgttctactggctaatcacacccctgtgctggctatcagtgttctgtggctgggtgatcaaaagctggaaaaagagagtgggctcagctatttctaggaccaatgacaccatcggttggcgagacaatagacgatacaggcaagacgtcgagagagcacagtacacaggaggagctccaggggctaaatactcattttatggagtaatggtccttggcctattaggtaatgtgcatagttgctctgagagtatcatagctgactccaaaatcatgcaatgcacaacttcgggaagttctaccctctgcaaggctagtgggactgtaattatgaagctagggcctataggctcggagtcctgcctgattctgaagggtctcaaggatagtgagaaacaatttatctcaatcaagaccatatcaagtgaactcacatgccgagagggagagtccttctggactactctatatactcctgtctgtctaagctcgcgaaggtgccacctgatgggagaatgtgtctccgaccgctgcctcaaatggaaaaccaatgaaacatctgcagaattcactgggaaggcacatggagaggttgtgcatgagaataggtgctttgagcagagcggtggaataggctacggatgctttaatgtgaacccttcttgtctctacgtccattcctatctcaaatctgtctacaagaatggatttaagatctttagatgtgtggcatggaaccataggattagacttgaagttactacccactcccggaaattcccaatggttttgatggctatgagcacacaaccgactgactggggttctattgggttaatcttagattcagaagggataacagggactaacgcgtattcctttatgaagcacgggtcaggaagctttgccatcatagatgacccatattccccagagcctcgtaaaggctttttaggagaagtgcgatgtccaacagaagaaacagctattcgggcgtcaccctcatgtaagatggcccctaacttgatcgagtaccagcctgagatggacactgcagagtgcactacaaacatgatagaccccatggccatattcaatcgagggtccttgccacaagtccgagatggaatgacattcacacaatcaattgagaagaacacagttcaagcactgacaacaggggaggttagagcttctatacgcctcacattggacgactatgatgtggtgtaccaaaatagccagtccgactgctcagctacatttaagaatctcaccggctgttattcatgtgatgagggttccagaatgtgctaccaggtgaaggcagaaggagaaactatctttcactttatcaatgaggatgaatccatcaatgtcattaacaaggtaaacccagacgtaagtgactactgcactgttctccacttctcaagacctgtcatctctattgaagggaggtatgactgcgggcttagcaaaagaccaatggtaataaaaggtactctaattgctactgccccgcatgatgacagaaagcatgaaggaggctcctcattgattgtcaaccccaaaggcggcacagttgatttcttcggatgggtgtctggactaacctcatggctaggtggacctctgaaaaccttcctgaccatccttggattcctagctctgggcctacttttagtagtgataatcatcatcattgctcgcactggggtgcaacaggccctaaaaaagaaaaacaagtaa

SEQ ID NO: 4683 - RNA, 4020 nt, synthetic construct
  misc_feature 1..4020: note = derived and/or modified CDS sequence (wt) from TOSV(5963930705)__KU935734.1__GP
  source 1..4020: mol_type = other RNA
atgtttattgcaaagttgttattaatttcctgtttagtgcagcaggcctatctgaaatatactattatttcagagatagggaacggcactagaacttccttttgctacagttcaagaactagcttggggagcctcttagaagcttgggacaacgtgactgagtcaattggcctgacttctggcacttgcaaagtggggtcactagagaacagggactgcaggaaagacataatgtccaactacgttgctgaggtgcactctaacctgcacggactgggagctatgatgcacaactacggtgatgacaagagggttgagatcctcaatgatgtcataccagatgagctcaatcctggacatcacaactgtagtgaccttgaccgaaagccattttggactgagtttattaatgtggcaaagccattgggtgaaatagtcccaatgtcagtgattccaccaccagttgtgaagctccagccacctgcagaaccatcctccaagaaacatgttccgtttgatgtacttttgtcagaagctgagaaggagctaaaccagacgaagattagactggaagatgagagaaagtccaatgcagaagagacagcaaaggagagggctaggatgaaggagattgaggaagaattgagaagggagtgggagctggaacggaagaggaaggacgcaatggcagatgatctagcaaaagaaacagcaagaaggagggagatagaaaggaaggcccatgagcttgatagaatgcttaaaaagaaggagcgcgaaagcctgattgcaaaagagaaagcagatgaggacatgagaagccatgtgcataaaccaaacacgactagagccccggcacccacaattatcaccactctgctcatggcgagtgcagccctagcgggacccctggaaaacagggagacaaatcatttgctcaacaggccaggaaatggggcttacactctaagcgactttgctgaatcaacctgcacactggcctatggatcagaatgtaaatcttgggagcaccttctgaatgaggagctgttccccttcttccattctaatcttgacaagtacagcatgctagaagctgcaacagagacagtacctatacttaataagagctctgcagtttgcaccatttctccttccacacattcatcgaatgcctgtgggagagaggctagtgtcattaggaagaaatgttatagtaacatgtcagccttcttctacatcaacctggcaggtcaaatcactgtggttaagtgtgaaacaaaccacgtcctttctagtgattgtggaaattgcatctctaagagcttgagtggccaaaaggtatacaccccagtgcaagatgtgttctgtcagaagggctggacacagtccatcccaagcacaagatattcaaaagacatctgttctattggtttgcacaccgtgaaggaatgcaagataggaaccactagctttgagagggtgggtttcatagttgtgaaaggccgcaagatgtacattgagcagatgaagatgagatcaaggcaggaatacagcgaagatcaatttctgtgctataaatcagaaagcggctctggctcatctgtcaagctaaagaagttcaaggttgaatcatgcaagggtgttactacatcatcagcctctaagtgctctggcgatgagtatttctgcagcaggtatccatgtgaagcagccaacgttgaagcccactgcattctaaggaggcatagtgcaatagtggaagtgaatgtcaacggcgtgtgggttgtgcccaggtgtattggctatgaggaggttctggtcaaaaggacatcactcaaggttgaagatacgacagaaagggaatgtgattcctgcttatgggaatgtgggaagaataagctgattgtcaagactcatggtcccaaagtggtttatgcaacagcatgcagccatggatcctgtaaaagtgtgatgcagaagccagcaacctttgtgtacctaccataccctggaaatagtgaaattgttgggggtgacatagggattcacatgacagaagagtcatcaccctcgaatatacacttagtagcacactgccctgcaagggactcatgtgatgtcagtgactgtctattctgcgttcacggactccttaattatcagtgccacaccttgttttcagcattgctcatatcaaccactgtgatgtcaattctcacattgctgctcttgcttgtgaaaggggcaaaggatcttgttaagaaattgttccactggctgatcactcctttatgctggctatcagtcttttgctgctggatggttaaaagctggaaaagaagagtgggttcagcaatttctaggacaaacgacactattggttggcgtgaaaacaggcggcatgctcaagacattgagagagcacagcacacgggaggggctccaggggccaaatattcattttatggggttatgattctaggattactgagtagtgcccagagttgctctgaaagtgtgatagcagactccaagatcatgcaatgcacaacctcagggagttccaccctttgcaaggcaagcgggacagtaatcatgagattgggacccataggctcagagtcttgtttgattctgaaagggctcaaggacagtgaaaagcagttcatatctattaagaccatatcaagtgaactcacgtgccgagaaggagaatctttctggaccaccctatacacacctatctgcttaagctcaagaagatgtcacttgatgggagaatgtgtctctgatcgctgcctcaagtggaagactaatcaaacatccgcagaatttacagggaaagcacatggtgacgttatgcacgagaacagatgctttgagcaaagtggaggaataggctacggatgttttaacgtaaacccttcttgtctctatgtccactcttatctcaagtctgtttacaggaatgggttcaaagttttcaggtgtgtggcatggaatcataggattagactagaggtgacgacacactcccgaaagttccctatggttttgatggccatgagcacacagcccactgactggggatccattggtttgattcttgactcagaagggataacaggaacaaattcttattcctttatgaaacatggctcaggaagttttgctataatagatgacccatattctccagagcctcgaaaagggttcctgggagaagtgcggtgccctacagaagagacagccatgcgagcatcaccttcttgcaagatggctccaaacttgattgagtatcagcctgaaatggacacagcagagtgtaccacaaatatgatagaccctatggctatattcaatcgaggatctctgccacaggttcgggatgggatgactttcacgcaatcaatagaaaagaacactgttcaggcattaacaacaggagaagttaaggcatccatccgcctcacattagatgattatgatgtggtgtatcaaaatagccagtctgactgctcagccacttttaagaacctcactggttgttactcatgtgatgaaggatccagactatgctatcaagtgaaggcagaaggcgagactatttttcactttatcaatgaagaagagtccatcaatgtcatcaataaggtaagcccgggagtgagcgactactgcaccgttctccatttctcaagtcctgttatttctattgagggaacatatgactgcgggctaagcaagagaccaatggtgataaaaggtactctaattgccactgctccacatgatgatagaaagcatgaaggaggttcttctttagtagtcaaccccaaaggtggttcagttgacttctttggatggttgtctggattgacctcatggctcggaggtcctctcaaaacatttctgactattcttggattcctagctgtgggcttactgttagtggtgataattatcatcatcattcgaactggaatgcaacaagctttgaagaagaagataaaataa

SEQ ID NO: 4684 - RNA, 4020 nt, synthetic construct
  misc_feature 1..4020: note = derived and/or modified CDS sequence (wt) from TOSV(H4906)__KU922125.1__GP
  source 1..4020: mol_type = other RNA
atgtttattgcaaagttgttattaatttcctgtttagtgcagcaggcctatctgaaatatactattatttcagagatagggaacggcactagaacttccttttgctacagttcaagaactagcttggggagcctcttagaagcttgggacaacgtgactgagtcaattggcctgacttctggcacttgcaaagtggggtcactggagaacagggactgcaggaaagacataatgtccaactacgttgctgaggtgcactctaacctgcacgggctgggagctatgatgcacaactacggtgatgacaagagggttgagatcctcaatgatgtcataccagatgagctcaatcctggacaccacaactgtagtgaccttgaccgaaagccattttggactgagtttattaatgtggcaaagccactgagtgaaatagtcccaatgtcagtgattccaccaccagttgtgaagccccagccacctgcagaaccatcctccaagaaacatgttccgtttgatgtacttttgtcagaagctgagaaggagctaaaccagacgaagattagactggaagatgagagaaagtccaatgcagaagagacagcaaaggagagggctaggatgaaggagattgaggatgaattgagaagggagtgggagctggaacggaagaggaaggacgcaatggcagatgatttagcaaaagaaacagcaagaaggagggagatagaaaggaaggcccatgagcttgatagaatgcttaaaaagaaggagcgcgaaagcctgattgcaaaagagaaagcagatgaggacatgagaagccatgtgcataaaccaaacacgactagagccccagcacccacaattatcaccactctactcatggcgagtgcagccctagcggggcccctggagaacagggagacaaatcatttgctcaacaggccaggaaatggggcttacactctaagcgactttgctgaatcaacctgcacactggcctatggatcagaatgcaaatcttgggagcaccttctgaatgaggagctgttccccttcttccattctaatcttgacaagtacagcatgctagaagctgcaacagagacagtacctatactcaataagagctctgcagtttgcaccatttctccttccacacattcatcgaatgcctgtgggagagaggctagtgtcattaggaagaaatgttatagtaacatgtcagccttcttctacattaacctggcaggtcaaattactgtggttaagtgtgaaacaaaccacgtcctttctagtgattgtggaaattgcatctctaagagcttgagtggccaaaaggtatacaccccagtgcaagatgtgttctgtcagaagggctggacacagtccatcccaagcacaagatattcaaaagacatctgttctattggtttgcacaccgtgaaggaatgcaagataggaaccactagctttgagagggtgggtttcatagttgtgaaaggccgcaagatgtacattgagcagatgaagatgagatcaaggcaggaatacagcgaagatcaatttttgtgctataaatcagaaagcggctctggctcatctgtcaagctaaagaagttcaaggttgaatcatgcaagggtgttactacatcatcagcctctaagtgctctggcgatgagtatttctgcagcaggtttccatgtgaaacagccaacgttgaagcccactgcattctaaggaggcatagtgcaatagtggaagtgaatgtcaacggcgtgtgggttgtgcctaggtgtattggctatgaggaggttctggtcaaaaggacatcactcaaggttgaagatacgacagaaagggaatgtgattcctgcttatgggaatgtgggaagaataagctgattgtcaagactcatggtcccaaagtggtttatgcaacagcatgcagccatggatcctgtaaaagtgtgatgcagaagccagcaacctttgtgtacctaccataccctggaaatagtgaaattgttgggggtgacatagggattcacatgacagaagagtcatcaccctcgaatatacacttagtagcacactgccctgcaagggactcatgtgatgtcagtgactgtctattctgcgttcacggactccttaattatcagtgccacaccttgttttcagcattgctcatatcaactactgtgatgtcaattctcacattgctgctcttgcttgtgaaaggggcaaaggatcttgttaagaaattgttccactggctgatcactcctttatgctggctatcagtcttttgctgctgggtggttaaaagctggaaaagaagagtgggttcagcaatttctaggacaaacgacactattggttggcgtgaaaacaggcggcatgctcaagacattgagagagcacagtacacaggaggggctccaggggccaaatattcattttatggggttatgattctaggattactgagtagtgcccagagttgctctgaaagtgtgatagcagactccaagatcatgcaatgcacaacttcagggagttccaccctttgcaaggcaagcgggacagtaatcatgagattgggacccataggctcagagtcttgtttgattctgaaagggctcaaggacagtgaaaagcagttcatatctatcaagaccatatcaagtgaactcacgtgccgagaaggagaatctttctggaccaccctatacacacctatctgcttaagctcaagaagatgtcacttgatgggagaatgtgtctctgatcgctgcctcaagtggaagactaatcaaacatccgcagaatttacagggaaagcacatggtgacgttatgcacgagaacagatgctttgagcaaagtggaggaataggctacggatgttttaacgtaaacccttcttgtctctatgtccactcttatctcaagtctgtttacaggaacgggttcaaagttttcaggtgtgtggcatggaatcataggattagactagagatgacgacacactcccgaaagttccctatggttttgatggccatgagcacacagcccactgactggggatccattggtttgattcttgactcagaagggataacaggaacaaattcttattcctttatgaaacatggctcaggaagttttgctataatagatgacccatattctccagagcctcgaaaagggttcctgggagaagtgcggtgtcctacagaagagacagccatgcgagcatcaccttcttgcaagatggctccaaacttgattgagtatcagcctgaaatggacacagcagagtgtaccacaaatatgatagaccctatggctatattcaatcgaggatctctgccacaggttcgggatgggatgactttcacgcaatcaatagaaaagaacactgttcaggcattaacaacaggggaagttaaggcatccatccgcctcacattagatgattatgatgtggtgtatcaaaatagccagtctgactgctcagccacatttaagaacctcactggttgttactcatgtgatgaaggatccagactatgctatcaagtgaaggcagaaggcgagactatttttcactttatcaatgaagaagagtccatcaatgtcatcaataaggtaaacccgggagtgagcgactactgcaccgttctccatttctcaaggcctgttatttctattgagggaacatatgactgcgggctaagcaagagaccaatggtgataaaaggtactctaattgccactgctccacatgatgatagaaagcatgaaggaggttcttctttagtagtcaaccccaaaggtggttcagttgacttctttggatggttgtctggattgacctcatggctcggaggtcctctcaaaacatttctgactattcttggattcctagctgtgggcttactgttagtggtgataattatcatcatcattcggactggaatgcaacaagctttgaagaagaagataaaataa

SEQ ID NO: 4685 - RNA, 4020 nt, synthetic construct
  misc_feature 1..4020: note = derived and/or modified CDS sequence (wt) from TOSV(MRS2010-4319501)__KC776215.1__GP
  source 1..4020: mol_type = other RNA
atgtttattgcaaagttgttattaatttcctgtttagtgcagcaggcctatctgaaatatactattatttcagagatagggaacggcactagaacttccttttgctacagttcaagaactagcttggggagcctcttagaagcttgggacaacgtgactgagtcaattggtctgatttctggcacttgcaaagtggggtcactggagaacagggactgcaggaaagacataatgtccaactacgttgctgaggtgcactctaacctgcacgggctgggagctatgatgcacaactacgctgatgacaagagggttgagatcctcaatgatgtcataccagatgagctcaatcctggacaccacaactgtagtgaccttgaccgaaagccattttggactgagtttattaatgtggcaaagccattgagtgaaatagtcccaatgtcagtgattccaccaccagttgtgaagctccagccacctgcagaaccatcctccaagaaacatgttccgtttgatgtacttttatcagaagctgagaaggagctaaaccagacgaagattagactggaagatgagagaaagtccaatgcagaagagacagcaaaggagagggctaggatgaaggagattgaggatgaattgagaagggagtgggagctggaacggaagaggaaggacgcaatggcagatgatttagcaaaagaaacagcaagaaggagggagatagaaaggaaggcccatgagcttgatagaatgcttaaaaagaaggagcgcgaaagcctgattgcaaaagagaaagcagatgaggacatgagaagccatgtgtataaaccaaacacgactagagccccagcacccacaattatcaccactctgctcatggcgagtgcagccctagcgggacccctggagaacagggagacaaatcatttgctcaacaggccaggaaatggggcttacactctaagcgactttgctgaatcaacctgcacactggcctatggatcagaatgcaaatcttgggagcaccttctgaatgaggagctgttccccttcttccattctaatcttgacaagtacagcatgctagaagctgcaacagagacagtacctatactcaataagagctctgcagtttgcaccatttctccttccacacattcatcgaatgcctgtgggagagaggctagtgtcattaggaagaaatgttatagcaacatgtcagccttcttctacattaacctggcaggtcaaattactgtggttaagtgtgaaacaaaccacgtcctttctagtgattgtggaaattgcatctctaagagcttgagtggccaaaaggtgtacaccccagtgcaagatgtgttctgtcagaagggctggacacagtccatcccaagcacaaagtattcaaaagacatctgttctattggtttgcacaccgtgaaggaatgcaagataggaatcactagctttgagagggtgggtttcatagttgtgaaaggccgcaagatgtacattgagcagatgaagatgagatcaaggcaggaatacagcgaagatcaatttttgtgctataaatcagaaagcagctctggctcatctgtcaagctaaagaagttcaaggttgaatcatgcaagggtgttactacatcatcagcctctaagtgctctggcgatgagtatttctgcagcaggtatccatgtgaaacagccaacgttgaagcccactgcattctaaggaggcatagtgcaatagtggaagtgaatgtcaacggcgtgtgggttgtgcctaggtgtattggctatgaggaggttctggtcaaaaggacatcactcaaggttgaagatacgacaggaagggaatgtgattcctgcttatgggaatgtgggaagaataagctgattgtcaagactcatggtcccaaagtggtttatgcaacagcatgcagccatggatcctgtaaaagtgtgatgcagaagccagcaacctttgtgtacctaccataccctggaaatagtgaaattgttgggggtgacatagggattcacatgacagaagagtcatcaccctcgaatatacacttagtagcacactgccctgcaagggactcatgtgatgtcagtgactgtctattttgcgttcacggactccttaattatcagtgccacaccttgttttcagcattgctcatatcaactactgtgatgtcaattctcacattgctgctcttgcttgtgaaaggggcaaaggatcttgttaagaaattgttccactggctgatcactcctttatgctggctatcagtcttttgctgctgggtggttaaaagctggaagagaagagtgggttcagcaatttctaggacaaacgacactattggttggcgtgaaaacaggcggcatgctcaagacattgagagagcacagtacacaggaggggctccaggggccaaatattcattttatggggttatgattctaggattactgagtagtgcccagagttgctctgaaagtgtgatagcagactccaagatcatgcaatgcacaacctcagggagttccaccctttgcaaggcaagcgggacagtaatcatgagagtgggacccataggctcagagtcttgtttgattctgaaagggctcaaggacagtgaaaagcagttcatatctatcaagaccatatcaagtgaactcacgtgccgagaaggagaatccttctggactaccctatacacacctatctgcttaagctcaagaagatgtcacttgatgggagaatgtgtctctgatcgctgcctcaagtggaagactaatcaaacatccgcagaattcacagggaaagcacatggtgacgttatgcacgagaacagatgctttgagcaaagtggaggaataggctacggatgttttaatgtaaacccttcttgtctctatgtccactcttatctcaagtctgtttacaggaacgggttcaaagttttcaggtgtgtggcatggaatcataggattagactagaggtgacgacacactcccgaaagttccctatggttttgatggccatgagtacacagcccactgactggggatccattggtttgattcttgactcagaaggggtaacaggaacaaattcttattcctttatgaaacatggctcaggaagttttgctataatagatgacccatattctccagagcctcgaaaagggttcctgggagaagtgcggtgtcctacagaagagacagccatgcgagcatcaccttcttgcaagatggctccaaacttgattgagtaccagcctgaaatggacacagcagagtgtaccacaaatatgatagaccctatggctatattcaatcgaggatctctgccacaggttcgggatggaatgactttcacgcagtcaatagaaaagaacactgttcaggcattaacaacaggggaagttaaggcatccatccgcctcacattagatgattatgatgtggtgtatcaaaatagccagtctgactgctcagccacatttaagaacctcactggttgttactcatgtgatgaaggatccagactatgctatcaagtgaaggcagaaggcgagactatttttcactttatcaatgaagaagagtccatcaatgtcatcaataaggtaagcccgggagtgagcgactactgcaccgttctccatttctcaaggcctgttatttctattgagggaacatatgactgcgggctaagcaagagaccaatggtgataaaaggtactctaattgccactgctccacatgatgatagaaagcatgaaggaggttcttctttagtagtcaaccccaaaggtggttcagttgacttctttggatggttgtctggattgacctcatggctcggaggtcctctcaaaacatttctgactattcttggattcctagctgtgggcttactgttagtggtgataattatcatcatcattcggactggaatgcaacaagctttgaagaagaagataaaataa

SEQ ID NO: 4686 - RNA, 4020 nt, synthetic construct
  misc_feature 1..4020: note = derived and/or modified CDS sequence (wt) from TOSV(Nice/113)__KU204982.1__GP
  source 1..4020: mol_type = other RNA
atgtttattgcaaagttgttattaatttcctgtttagtgcagcaggcctatctgaaatatactattatttcagagatagggaacggcactagaacttccttttgctacagttcaagaactagcttggggagcctcttagaagcttgggacaacgtgactgagtcaattggcctgacttctggcacttgcaaagtggggtcactagagaacagggactgcgggaaagacataatgtccaactacgttgctgaggtgcactctaacctgcacgggctgggagctatgatgcacaactacggtgatgacaagagggttgagatcctcaatgatgtcataccagatgagctcaatcctggacaccacaactgtagtgaccttgaccgaaagccattttggactgagtttattaatgtggcaaggccattaagtgaaatagcccctatgtcagtgattccaccaccagttgtgaagctccagccacctgcagaaccatcctccaagaaacatgttccgtttgatgtacttttgtcagaagctgagaaggagctaaaccagacgaagattagactggaagatgagagaaagtccaatgcagaagagacagcaaaggagagggctaggatgaaggagattgaggatgaattgagaagggagtgggagctggaacggaagaggaaggacgcaatggcagatgatttagcaaaagaaacagcaagaaggagggagatagaaaggaaggcccatgagcttgatagaatgcttaaaaagaaagagcgcgaaagcctgattgcaaaagagaaagcagatgaggacatgagaagccatgtgcataaaccaaacacgactagagccccagcacccacaattatcaccactctgctcatggcgagtgcagccctagcgggacccctggagaacagggagacaaatcatttgctcaataggccaggaaatggggcttacactctaagcgactttgctgaatcaacctgtacactggcctatgggtcagaatgcaaatcttgggagcaccttctgaatgaggagctgttccccttcttccattctaatcttgacaagtacagcatgctagaagctgcaacagagacagtacctatacttaataagagctctgcagtttgcaccatttctccttccacacattcatcgaatgcctgtgggagagaggctagtgtcatcaggaagaaatgttatagtaacatgtcagccttcttctacattaacctggcaggtcaaatcactgtggttaagtgtgaaacaaaccacgtcctttctagtgattgtggaaattgcatctctaagagcttgagtggccaaaaggtatacaccccagtgcaagatgtattctgtcagaagggctggacacagtccatcccaagcacaagatattcaaaagacatctgttctataggtttgcacaccgtgaaggaatgcaagataggaaccactagctttgagagggtgggtttcatagttgtgggaggccgcaagatgtacattgagcagatgaagatgagatcaaggcaggaatacagcgaagatcaatttttgtgctataaatcagaaagcggctctggctcatctgtcaagctaaagaagttcaaggttgaatcatgcaagggtgttactacatcatcagcctctaagtgctctggcgatgagtatttctgcagcaggtatccatgtgaaacagccaacgttgaagcccactgcattctaaggaggcatagtgcaatagtggaagtgaatgtcaacggcgtgtgggttgtgcctaggtgtattggctatgaggaggttctggtcaaaaggacatcactcaaggttgaagatacgacagaaagggaatgtgattcctgcttatgggaatgtgggaagaataagctgattgtcaagactcatggtcccaaagtggtttatgcaacagcatgcagccatggatcctgtaaaagtgtgatgcagaagccagcaacctttgtgtacctaccataccctggaaatagtgaaattgttgggggtgacatagggattcacatgacagaagagtcatcaccttcgaatatacacttagtagcacactgccctgcaagggactcatgtgatgtcagtgactgtctattctgcgttcacggactccttaattatcagtgccacaccttgttttcagcattgctcatatcaactactgtgatgtcaattctcacattgctgctcttgcttgtgaaaggggcaaaggatcttgttaagaaattgttctactggctgatcactcctttatgctggctatcagtcttttgctgctgggtgattaaaagctggaaaagaagagtgggttcagcaatttctaggacaaacgacactattggttggcgtgaaaacaggcggcatgctcaagacattgagagagcacagtacacaggaggggctccaggggccaaatattcattttatggggttatgattctaggattactgagtagtgcccagagttgctctgaaagtgtgatagcagactccaagatcatgcaatgcacaacctcagggagttccaccctttgcaaggcaagcgggacagtaatcatgagattgggacccataggctcagagtcttgtttgattctgaaagggctcaaggacagtgaaaagcagttcatatctatcaagaccatatcaagtgaactcacgtgccgagaaggagaatctttctggactaccctatacacacctatctgcttaagctcaagaagatgtcacttgatgggagaatgtgtctctgatcgctgcctcaagtggaagactaatcaaacatccgcagaatttacagggaaagcacatggtgacgttatgcacgagaacagatgctttgagcaaagtggaggaataggctacggatgttttaacgtaaacccttcttgtctctatgtccactcttatctcaagtctgtttacaggaacgggttcaaagttttcaggtgtgtggcatggaatcataggattagactagaggtgacgacacactcccgaaagttccctatggttttgatggccatgagcacacagcccactgactggggatccattggcttgattcttgactcagaggggataacaggaacaaactcttattcctttatgaaacatggctcaggaagttttgctataatagatgacccatattctccagagcctcgaaaagggttcctgggagaagtgcggtgtcctacagaagagacagccatgcgagcatcaccttcttgcaagatggctccaaacttgattgagtatcagcctgaaatggacacagcagagtgtaccacaaatatgatagaccctatggctatattcaatcgaggatctctgccacaggttcgggatgggatgactttcacgcaatcaatagaaaagaacactgttcaggcattaacaacaggggaagttaaggcatccatccgcctcacattagatgattatgatgtggtgtatcaaaatagccagtctgactgctcagccacatttaagaacctcactggttgttactcatgtgatgaaggatccagactatgctatcaagtgaaggcagaaggcgagactatttttcactttatcaatgaagaagagtccatcaatgtcatcaataaggtgagcccggaagtgagcaactactgcaccgttctccatttctcaaggcctgttatttctattgagggaacatatgactgcgggctaagcaagagaccaatggtgataaaaggtactctaattgccactgctccacatgatgatagaaagcatgaaggaggttcttctttagtagtcaaccccaaaggtggttcagttgacttcttcggatggttgtctggattgacctcatggctcggaggtcctctcaaaacatttctgactattcttgggttcctagctgtgggcttactgttagtggtgataattatcatcatcattcgaactggaatgcaacaagctttgaagaagaagataaaataa

SEQ ID NO: 4687 - RNA, 4020 nt, synthetic construct
  misc_feature 1..4020: note = derived and/or modified CDS sequence (wt) from TOSV(P233)__KU204976.1__GP
  source 1..4020: mol_type = other RNA
atgtttattgcaaagttgttattaatttcctgtttagtgcagcaggcctatctgaaatatactattatttcagagatagggaacggcactagaacttccttttgctacagttcaagaactagcttggggagcctcttagaagcttgggacaacgtgactgagtcaattggcctgacttctggcacttgcaaagtggggtcactggagaacagggactgcaggaaagacataatgtccaactacgttgctgaggtgcactctaacctgcacgggctgggagctatgatgcacaactacggtgatgacaagagggttgagatcctcaatgatgtcataccagatgagctcaatcctggacaccacaactgtagtgaccttgaccgaaagccattttggactgagtttattaatgtggcaaagccattgagtgaaatagtcccaatgtcagtgattccaccaccagttgtgaagccccagccacctgcagaaccatcctccaagaaacatgttccgtttgatgtacttttgtcagaagctgagaaggagctaaaccagacaaagattagactggaagatgagagaaagtccaatgcagaagagacagcaaaggagagggctaggatgaaggagattgaggatgaattgagaagggagtgggagctggaacggaagaggaaggacgcaatggcagatgatttagcaaaagaaacagcaagaaggagggagatagaaaggaaggcccatgagcttgataaaatgcttaaaaagaaggagcgcgaaagcctgattgcaaaagagaaagcagatgaggacatgagaagccatgtgcataaaccaaacacgactagagccccagcacccacaattatcaccactctgctcatggcgagtgcagccctagcgggacccctggagaacagggagacaaatcatttgctcaacaggccaggaaatggggcttacactctaagcgactttgctgaatcaacctgcacattggcctatggatcagaatgcaaatcttgggagcaccttctgaatgaggagctgttccccttcttccattctaatcttgacaagtacagcatgctagaagctgcaacagagacagtacctatactcaataagagctctgcagtttgcaccatctctccttccacacattcatcgaatgcctgtgggagagaggctagtgtcattaggaagaaatgttatagtaacatgtcagccttcttctacattaacctggcaggtcaaattactgtgattaagtgtgaaacaaaccacgtcctttctagtgattgtggaaattgcatctctaagagcttgagtggccaaaaggtatacaccccagtgcaagatgtgttctgtcagaagggctggacacagtccatcccaagcacaagatattcaaaagacatctgttctattggtttgcacaccgtgaaggaatgcaagataggaaccactagctttgagagggtgggtttcatagttgtgaaaggccgcaagatgtacattgagcagatgaagatgagatcaaggcaggaatacagcgaagatcaatttttgtgctataaatcagaaagcggctctggctcatctgtcaagctaaagaagttcaaggttaaatcatgcaagggtgttactacatcatcagcctctaagtgctctggcgatgagtatttctgcagcaggtatccatgtgaaacagccaacgttgaagcccactgcattctaaggaggcatagtgcaatagtggaagtgaatgtcaacggcgtgtgggttgtgcctaggtgtattggctatgaggaggttctggtcaaaaggacatcactcaaggttgaagatacgacaggaagggaatgtgattcctgcttatgggaatgtgggaagaataagctgattgtcaagactcatggtcccaaagtggtttatgcaacagcatgcagccatggatcctgtaaaagtgtgatgcagaagccagcaacctttgtgtacctaccataccctggaaatagtgaaattgttgggggtgacatagggattcacatgacagaagagtcatcaccctcgaatatacacttagtagcacactgccctgcaagggactcatgtgatgtcagtgactgtctattctgcgttcacggactccttaattatcagtgccacaccttgttttcagcattgctcatatcaactactgtgatgtcaattctcacattgctgctcttgcttgtgaaaggggcaaaggatcttgttaagaaattgttccactggctgatcactcctttatgctggctatcagtcttttgctgctgggtggttaaaagctggaaaagaagagtgggttcagcaatttctaggacaaacgacactattggttggcgtgaaaacaggcggcatgctcaagacattgagagagcacagtacacaggaggggctccaggggccaaatattcattttatggggttatgattctaggattactgagtagtgcccagagttgctctgaaagtgtgatagcagactccaagatcatgcaatgcacaacctcagggagttccaccctttgcaaggcaagcgggacagtaatcatgagattgggacccataggctcagagtcttgtttgattctgaaagggctcaaggacagtgaaaagcagttcatatctatcaagaccatatcaagtgaactcacgtgccgagaaggagaatctttctggaccaccctatacacacctatctgcttaagctcaagaagatgtcacttgatgggagaatgtgtctctgatcgctgcctcaagtggaagactaatcaaacatccgcagaattcacagggaaagcacatggtgacgttatgcacgagaacagatgctttgagcaaagtggaggaataggctacggatgttttaacgtaaacccttcttgtctctatgtccactcttatctcaagtctgtttacaggaacgggttcaaagttttcaggtgtgtggcatggaatcataggattagactagaggtgacgacacactcccgaaagttccctatggttttgatggccatgagcacacagcccactgactggggatccattggtttgattcttgactcagaagggataacaggaacaaattcttattcctttatgaaacatggctcaggaagttttgctataatagatgacccatattctccagagcctcgaaaagggttcctgggagaagtgcggtgtcctacagaagagacagccatgcgagcatcaccttcttgcaagatggctccaaacttgattgagtatcagcctgaaatggacacagcagagtgtaccacaaatatgatagaccctatggctatattcaatcgaggatctctgccacaggttcgggatgggatgactttcacgcaatcaatagaaaagaacactgttcaggcattaacaacaggggaagttaaggcatccatccgcctcacattagatgattatgatgtggtgtatcaaaatagccagtctgactgctcagccacattcaagaacctcactggttgttactcatgtgatgaaggatccagactatgctatcaagtgaaggcagaaggcgagactatttttcactttattaatgaagaagagtccatcaatgtcatcaataaggtaagcccgggagtgagcgactactgcaccgttctccatttctcaaggcctgttatttctattgagggaacatatgactgcgggctaagcaagagaccaatggtgataaaaggtactctaattgccactgctccacatgatgatagaaagcatgaaggaggttcttctttagtagtcaaccccaaaggtggttcagttgacttctttggatggttgtctggattgacctcatggctcggaggtcctctcaaaacatttctgactattcttggattcctagctgtgggcttactgttggtggtgataattatcatcatcattcggactggaatgcaacaagctttgaagaagaagataaaataa

SEQ ID NO: 4688 - RNA, 4020 nt, synthetic construct
  misc_feature 1..4020: note = derived and/or modified CDS sequence (wt) from TOSV(T152)__JX867535.1__GP
  source 1..4020: mol_type = other RNA
atgtttattgcaaagttgttattaatttcctgtttagtgcagcaggcctatctgaaatacactattatttcagaaatagggaacggcactagaacttcttcttgttatagctcaagaaccagcttggggagcctcctggaagcttgggacaacataactgagtctattggtctgacatctggcacttgcaaagtgggatcactggaaaacagggattgcaaaagagacatcatgtcaaattatgttgcagaagtgcattccaacttacacggcctaggagctatgatgcacaactatggtgatgacaagagggttgaggtcctcaatgatgtcatcccagatgagctcaatccaggacgccacaattgcagtgacctagaccggaagccattctggacagagtttattaatgtggcaaagccaacgaataaaatagctcccatatcagtgatcccaccaccaattgtgaagcctataccaattgcagaaccaaccactaagaaaaacatcccatttgataaactcctatctgaagcagaaaaggagttgaaccaaacaaaaatcagattggaaaccgaaagaaggtctaatgcggaagaggctgcaaaagagagggccaggatgagagaaattgaagacaagctgagaaaggattgggagctggaacgagagagaaaagatgcagtggcggacgacctggcaaaagaaatagcgagaagaagagagatagagagaaaagctcatgaattagataagatgctcaagaagaaggagcgtgaggatctggtggcaatagaaaaggtgagtgaggatatgagaaaccatgtacgtagaccaaatacaaccatagcccctgctcccacgatcattactaccctgctcttggccagtgcagtaatggcaggacctttggagaacagggaaacaaaccacttactaaacaggccagggaatggagcttacaccctaagtgactttgctgagtccacctgcacgctagcttatggctcagagtgcaaatcctgggagcaccaattggatgagctgtcttttcccttcttccactctaaccttgacaagtacagcatgctagaggctgcaacagagacaataccaatactcaacaagagctcagctgtctgcacaatttccccatcaacgcattcatcaaatgcatgtggcagggaagccagcctcataaagaagaaatgtggaagcaatatgtcggctttcttctatgttaacctagccggtcagataactgttgtcaagtgtgatacaaaccatgtcttgtctaacgactgtgggaattgtatctcgaaaaccttgagcggtcagaagatttatactccagttcaggatatgttctgtcagaaaggctggacagagtccatcccaagcacaaggtactcaaaagacctctgttctattggcttgcacactgtgaaggaatgcaagactggcaccaccaactttgagagagtgggtttcattgttgtggagagtcgcaagatgtacatagagcagatgaagatgagatcaaggcaagaattcagcgaagaccagttcttatgctacaaatcagagagcagttctggctcttctgtaaaactaaagaaggtcaaagttgagtcatgcaaaggtgttacaacatcatcagcctctaagtgctctggggatgaatatttctgcagcaggtacccatgtgaaactgcaaatgttgaagcccattgcattctacgaaggcatagtgcagttatagaagtgaatgtcaatggcgtatgggttgtgccgagatgcattggttatgaagaggttcttgtaagaaggacttcactcaaagtagaagatacatctagtagagaatgtgatacctgcttatgggaatgcgggaaaaataaactaattgtcaaaactcatggccccaaaatagtttatgcaacagcatgtagccatgggtcttgcaagagtgtgatgcaaaagccagcgaccttcgtgtttctgccgtacccaggaaacagcgagattgttggaggtgatataggggtccacatgacagaggaatcatcaccttcaaacatacacatggtggcacactgccctgcgaaggattcctgtgaggttagcagctgcctattctgtgtgcacggactgcttaattaccagtgccacaccttgttctctgcactactaatatccactactgtgatgtccattcttacattgctacttcttcttgtgaagggggctaaagatcttgtcaagagattattctactggctaattacacctctgtgctggctatcagtgttctgtagctggatgatcaaaagctggagaaagagagtgggctcagctatttctagaaccaatgacaccattggttggcgtgacaatagacgatatgggcaagacgttgagagagcacagtacacaggaggagctccagggactaaatattcattttatggagtgatgattcttggcctattaggtaacgtgcatagttgctctgagagtgtcatagccgactccaaagtcatgcaatgcacaacttcggggagttctaccctctgcaaggctagtgggactgtgattatgaagctagggcctataggctcagagtcctgcctgattttgaagggtcttaaggacagtgaaaagcaattcatctcaatcaagacaatatcaagtgaactcacatgccgagagggagagtccttctggactactctatatactcctgtctgtctaagttcgcgaaggtgccacctaatgggagaatgtgtctccgaccgctgccttaagtggaaaactaatgaaacatctgcagaattcactgggaaggcacatggagaagttatgcatgagaataaatgctttgagcagagcggtggaataggctatggatgctttaatgtgaacccttcttgtctctacgtccattcttatctcaaatctgtctacaagaacggattcaagatctttagatgtgtggcatggaaccataggatcagacttgaagttaccactcactccaggaagttcccaatggttttgatggctatgagcacacaacccactgactggggttctattgggttaatcctagattcagaagggataacagggactaatgcgtactccttcatgaagcacgggtcaggaagctttgccattatagatgacccatattctccagagcctcgtaaaggctttttaggagaagtgcgatgtccgacagaagagacagctattcgggcgtcaccctcatgtaagatggctcctaacttgattgagtaccagcccgagatggacactgcagagtgcactacaaacatgatagatcccatggccatattcaatcgagggtccttgccacaagtccgggatggaatgacatttacacaatcaattgagaagaacacagttcaagcactgacaacaggggaggttagagcttccatacgcctcacattggacgactatgacgtggtgtatcagaatagccagtctgactgctcagctacatttaagaatctcaccggctgttattcatgtgatgagggctccagaatgtgctaccaggtgaaggcagaaggagaaactatctttcactttgtcaatgaggatgaatccatcaatgttattaacaaggtgagcccagacgtaagtgactactgcactgttctccacttctcaagacctgtcatctctattgaagggaggtatgactgcgggcttagcaaaagaccaatggtaataaaaggtactctaattgctactgccccgcatgatgatagaaagcatgaaggaggttcctcattggttgtcaaccccaaaggcggcacagttgacttcttcggatgggtgtctggactaacctcgtggctaggtggacctctgaagaccttcttgaccatccttggattcctagctctgggcctactcttagtagtggtgatcatcatcattgctcgtactggggtgcagcaggccctgaaaaagaaaaacaagtaa

SEQ ID NO: 4689 - RNA, 4020 nt, synthetic construct
  misc_feature 1..4020: note = derived and/or modified CDS sequence (wt) from TOSV(TOSV/P51)__KU204979.1__GP
  source 1..4020: mol_type = other RNA
atgtttattgcaaagttgttattaatttcctgtttagtgcagcaggcctatctgaaatatactattatttcagagatagggaacggcactagaacttccttttgctacagttcaagaactagcttggggagcctcttagaagcttgggacaacgtgactgagtcaattggcctgacttctggcacttgcaaagtggggtcactggagaacagggactgcaggaaagacataatgtccaactacgttgctgaggtgcactctaacctgcacgggctgggagctatgatgcacaactacggtgatgacaagagggttgagatcctcaatgatgtcataccagatgagctcaatcctggacaccacaactgtagtgaccttgaccgaaagccattttggactgagtttattaatgtggcaaagccattgagtgaaatagtcccaatgtcagtgattccaccaccagttgtgaagctccagccacctgcagaaccatcctccaagaaacatgttccgtttgatgtacttttgtcagaagctgagaaggagctaaaccagacaaaaattagactggaagatgagagaaagtccaatgcagaagagacagcaaaggagagggctaggatgaaggagattgaggatgaattgagaagggagtgggagctggaacggaagaggaaggacgcaatggcagatgatttagcaaaagaaacagcaagaaggagggagatagataggaaggcccatgagcttgatagaatgcttaaaaagaaggagcgcgaaagcctgattgcaaaagagaaagcagatgagaacatgagaagccatgtgcatgaaccaaacacgactagagccccagcacccacaattatcaccactctgctcatggcaagtgcagccctagcgggacccctggagaacagggagacaaatcatttgctcaacaggccaggaaatggggcttacactctaagcgactttgctgaatcaacctgcacactggcctatggatcagaatgcaaatcttgggagcaccttctgaatgaggagctgttccccttcttccattctaatcttgacaagtacagcatgctagaagctgcaacagagacagtacctatactcaataagagctctgcagtttgcaccatttctccttccacacattcatcgaatgcctgtgggagagaggctagtgtcattaggaagaaatgttatagtaacatgtcagccttcttctacattaacctggcaggtcaaattactgtggttaagtgtgaaacaaaccacgtcctttctagtgattgtggaaattgcatctctaagagcttgagtggccaaaaggtatacaccccagtgcaagatgtgttctgtcagaagggctggacacagtccatcccaagcacaagatattcaaaagacatctgttctattggtttgcacaccgtgaaggaatgcaagataggaaccactagctttgagagggtgggtttcatagttgtgaaaggccgcaagatgtacattgagcagatgaagatgagatcaaggcaggaatacagcgaagatcaatttttgtgctataaatcagaaagcggctctggctcatctgtcaagctaaagaagttcaaggttgaatcatgcaagggtgttactacatcatcagcctctaagtgctctggcgatgagtatttctgcagcaggtatccatgtgaaacagccaacgttgaagcccactgcattctaaggaggcacagtgcaatagtggaagtgaatgtcaacggcgtgtgggttgtgcctaggtgtattggctatgaggaggttctggtcaaaaggacatcactcaaggttgaagatacgacagggagggaatgtgattcctgcttatgggaatgtgggaagaataagctgattgtcaagactcatggtcccaaagtggtttatgcaacagcatgcagccatggatcctgtaaaagtgtgatgcagaagccagcaacctttgtgtacctaccataccctggaaatagtgaaattgttgggggtgacatagggattcacatgacagaagagtcatcaccctcgaatatacacttagtagcacactgccctgcaagggactcatgtgatgtcagtgactgtctattctgcgttcacggactccttaattatcagtgccacaccttgttttcagcattgctcatatcaactactgtgatgtcaattctcacattgctgctcttgcttgtgaaaggggcaaaggatcttgttaagaaattgttctactggctgatcactcctttatgctggctatcagtcttttgctgctgggtggttaaaagctggaaaagaagagtgggttcagcaatttctaggacaaacgacactattggttggcgtgaaaacaggcggcatgctcaagacattgagagagcacagtacacaggaggggctccaggggccaaatattcattttatggggttatgattctaggattactgagtagtgcccagagttgctctgaaagtgtgatagcagactccaagatcatgcaatgcacaacctcagggagttccaccctttgcaaggcaagcgggacagtaatcatgagattgggacccataggctcagagtcttgtttgattctgaaagggctcaaggacagtgaaaagcagttcatatctatcaagaccatatcaagtgaactcacgtgccgagaaggagaatctttctggaccaccctatacacacctatctgcttaagctcaagaagatgtcacttgatgggagaatgtgtctctgatcgatgcctcaagtggaagactaatcaaacatccgcagaattcacagggaaagcacatggtgacgtcatgcacgagaacagatgctttgagcaaagtggaggaataggctacggatgttttaacgtaaacccttcttgtctctatgtccactcttatctcaagtctgtttacaggaacgggttcaaagttttcaggtgtgtggcatggaatcataggattagactagaggtgacgacacactcccgaaagttccctatggttttgatggccatgagcacacagcccactgactggggatccattggtttgattcttgactcagaagggataacaggaacaaattcttattcctttatgaaacatggctcaggaagttttgctataatagatgacccatattctccagagcctcgaaaagggttcctgggagaagtgcggtgtcctacagaagagacagccatgcgagcatcaccttcttgcaagatggctccaaacttggttgagtatcagcctgaaatggacacagcagagtgtaccacaaatatgatagaccctatggctatattcaatcgaggatctctgccacaggttcgggatgggatgactttcacgcaatcaatagaaaagaacactgttcaggcattaacaacaggggaagttaaggcatccatccgcctcacattagatgattatgatgtggtgtatcaaaatagccagtctgactgctcagccacatttaagaacctcactggttgttactcatgtgatgaaggatccagactatgctatcaagtgaaggcagaaggcgagactatttttcactttattaatgaagaagagtccatcaatgtcatcaataaggtaagcccgagagtgagcgactactgcaccgttctccatttctcaaggcctgttatttctattgagggaacatatgactgcgggctaagcaagagaccaatggtgataaaaggtactctaattgccactgctccacatgatgatagaaagcatgaaggaggttcttctttagtagtcaaccccaaaggtggttcagttgacttctttggatggttgtctggattgacctcatggctcggaggtcctctcaaaacatttctgactattcttggattcctagctgtgggcttactgttggtggtgataattatcatcatcattcggactggaatgcaacaagctttgaagaagaagataaaataa

SEQ ID NO: 4690 - RNA, 4020 nt, synthetic construct
  misc_feature 1..4020: note = derived and/or modified CDS sequence (wt) from TOSV(TOSV_Italy/BB8/2014/human)__KY626661.1__GP
  source 1..4020: mol_type = other RNA
atgtttattgcaaagttgttattaatttcctgtttagtgcagcaggcctatctgaaatacactattatttcagaaatagggaacggcactagaacttctttttgttatagctcaagaactagtttggggagcctcctggaagcttgggacaatataactgagtctattggtctgacgtctggcacttgtaaagtaggatcactggagaacagggattgcaaaagagacatcatgtcaaattatgttgcagaagtgcattccaacttacatggcctaggagctatgatgcacaactatggtgatgacaagagggttgaggtcctcaatgatgtcatcccagatgagctcaatccaggacgtcacaactgcagtgacctagaccggaagccattttggacagagttcattgatgtggcgaagccaacgaacaaaatagctcctatgtcagtgatcccaccaccaattgtgaaacccataccagttgcagaatcaaccattaagaaaagcatcccatttgataaactcttatctgaagcagaaaaggagttgaaccaaactaaaatcagattggaaaccgaaagaaggtctaatgcagaagaagctgcaaaagaaagggccaggatgagggaaattgaagacaagctgagaaaggactgggagctagaacgggagagaaaagatgcagtggcagacgacctggcaaaagaaatagcgagaagaagagagatagagagaaaagctcatgaattagataagatgctcaagaagaaggagcgtgaagatctggtggcaagagaaagggtgagtgaggatatgagaaaccatgtgtgtaaaccaaatacaaccatagcccctgctcccacaattattactaccctgctcatggccagtgcagtaatggcaggacctttggagaacagggaaacaaaccacttactaaacaggccagggaatggagcttacaccctaagtgactttgctgagtccacctgcacgctagcttatggctcagagtgcaaatcctgggagcaccaactggatgagctgtcttttcccttcttccactctaaccttgacaagtacagcatgctggaggctgcaacagagacaataccgatactcaacaagagctcagctgtctgcacaatttccccatccacgcactcatcaaatgcatgtggtagggaagccagcctcataaagaagaaatgtggaagcaatatgtcagctttcttttatgttaacctagccggtcagataactgttgtcaagtgtgatacaaaccatgtcttgtctaacgactgtgggaattgtatctcaaaaaccttgagcggccagaagatttatactccagttcaggatatgttctgtcagaagggttggacagagtccatcccaaacacaaggtactcaaaagacctctgttctattggcctgcattctgtgaaagaatgcaagactggtaccaccaactttgagagagtgggtttcattgttgtgaagggtcggaagatgtacattgagcagatgaagatgagatcgaggcaagaattcagcgaagaccagttcttatgctacaaatcagagagcagttccggctcttctgtgaaactaaagaaggttaaggttgagtcatgcaaaggtgtcacaacatcatcagcctctaagtgctctggggatgaatatttctgcagcaggtacccatgtgaaactgcaaatgttgaggcccactgcattcttcgaaggcatagtgcagttatagaagtgaatgtcaatggtgtatggattgtgccgagatgcattggttatgaagaggttcttgttagaaggacttcattaaaagttgaagatacatctagtagagaatgtgatacctgcttatgggaatgcgggaaagataaactaattgtcaaaactcatggccctaaaatagtttatgcaacagcatgtagccatgggtcttgcaagagtgtgatgcaaaagccagcaaccttcgtgtacttgccgtacccaggaaacagcgagattgttggaggtgatataggggtccacatgacagaggaatcatcaccttcaaacatacacatggtggcacactgccctgcgaaggattcttgtgaggttagcagctgcctattctgtgtgcacggactgcttaattaccagtgccacaccttgttctctgcattactaatatccaccactgtgatgtccattcttacactgctacttcttcttatgaagggagctaaagatcttgtcaagagattgttctactggctaatcacacccctgtgctggctatcagtgttctgtggctgggtgatcaaaagctggaaaaagagagtgggctcagctatttctaggaccaatgacaccatcggttggcgagacaatagacgatacaggcaagacgtcgagagagcacagtacacaggaggagctccaggggctaaatactcattttatggagtaatggtccttggcctattaggtaatgtgcatagttgctctgagagtgtcatagctgactccaaaatcatgcaatgcacaacttcgggaagttctaccctctgcaaggctagtgggactgtaattatgaagctagggcctataggctcagagtcctgcctgattttgaagggtctcaaggatagtgagaaacaattcatctcaatcaagaccatatcaagtgaactcacatgccgagagggagagtccttctggactactctatatactcctgtctgtctaagctcgcgaaggtgccacctgatgggagaatgtgtctccgaccgctgcctcaaatggaaaaccaatgaaacatctgcagaattcactgggaaggcacatggagaggttatgcatgagaataggtgctttgagcagagcggtggaataggctacggatgttttaatgtgaacccttcttgtctctacgtccattcctatctcaaatctgtctacaagaatggatttaagacctttagatgtgtggcatggaaccataggattagacttgaagttactacccactcccggaaattcccaatggttttgatggctatgagcacacaaccgactgactggggttctattgggttaatcctagattcagaagggataacagggactaacgcgtattcctttatgaggcacgggtcaggaagctttgccatcatagacgacccatattccccagagcctcgtaaaggctttctaggagaagtgcgatgtccaacagaagaaacagctattcgggcgtcaccctcatgtaagatggcccctaacttgatcgaataccagcctgagatggacactgcagagtgcactacaaacatgatagaccccatggccatattcaatcgagggtccttgccacaagtccgagatggaatgacattcacacaatcaattgagaagaacacagttcaagcactgacaacaggggaagttagagcttccatacgcctcacattggacgactatgatgtggtgtaccaaaatagccagtccgactgttcagctacatttaagaatctcaccggctgttattcatgtgatgagggttccagaatgtgctaccaggtgaaggcagaaggagaaactatctttcactttatcaatgaggatgaatccatcaatgtcattagcaaggtaaacccagacgtaagtgactactgcactgttctccacttctcaagacctgtcatctctattgaagggaggtatgactgcgggcttagcaaaagaccaatggtaataaaaggtactctaattgctactgccccgcatgatgacagaaagcatgaaggaggctcctcattgattgtcaaccccaaaggcggcacagttgatttcttcggatgggtgtctggactaacctcatggctaggtggacctctgaaaaccttcctgaccatccttggattcctagctctgggcctacttttagtagtgataatcatcatcattgctcgcactggggtgcaacaggccctaaaaaagaaaaacaagtaa

SEQ ID NO: 4691 - RNA, 4020 nt, synthetic construct
  misc_feature 1..4020: note = derived and/or modified CDS sequence (wt) from TOSV(TOSV-54441132704)__KX010933.1__GP
  source 1..4020: mol_type = other RNA
atgtttattgcaaagttgttattaatttcctgtttagtgcagcaggcctatctgaaatatactattatttcagagatagggaacggcactagaacttccttttgctacagttcaagaactagcttggggagcctcttagaagcttgggacaacgtgactgagtcaattggcctgacttctggcacttgcaaagtggggtcactggagaacagggactgcaggaaagacataatgtccaactacgttgctgaggtgcactctaacctgcacgggctgggagctatgatgcacaactacggtgatgacaagagggttgagatcctcaatgatgtcataccagatgagctcaatcctggacaccacaactgtagtgaccttgaccgaaagccattctggactgagtttattaatgtggcaaagccattgagtgaaatagtcccaatgtcagtgattccaccaccagttgtgaagctccagccacctgcagaaccatcctccaagaaacatgttccgtttgatgtacttttgtcagaagctgagaaggagctaaaccagacaaagattagactggaagatgagagaaagtccaatgcagaagagacagcaaaggagagggctaggatgaaggagattgaggatgaattgagaagggagtgggagctggaacggaagaggaaggacgcaatggcagatgatttagcaaaagaaacagcaagaaggagggagatagaaaggaaggcccatgagcttgataaaatgcttaaaaagaaggagcgcaaaagcctgattgcaaaagagaaagcagatgtggacatgagaagccatgtgcataaaccaaacacgactagagccccagcacccacaattatcaccactctgctcatggcgagtgcagccctagcgggacccctggagaacagggagacaaatcatttgctcaacaggccaggaaatggggcttacactctaagcgactttgctgaatcaacctgcacactggcctatggatcagaatgcaaatcttgggagcaccttctgaatgaggagctgttccccttcttccattctaatcttgacaagtacagcatgctagaagctgcaacagagacagtacctatactcaataagagctctgcagtttgcaccatttctccttccacacattcatcgaatgcctgtgggagagaggctagtgtcattaggaagaaatgttatagtaacatgtcagccttcttctacattaacctggcaggtcaaattactgtgattaagtgtgaaacaaaccacgtcctttctagtgattgtggaaattgcatctccaagagcttgagtggccaaaaggtatacaccccagtgcaagatgtgttctgtcagaagggctggacacagtccatcccaagcacaagatattcaaaagacatctgttctattggtttgcacaccgtgaaggaatgcaagataggaaccactagctttgagagggtgggtttcatagttgtgaaaggccgcaagatgtacattgagcagatgaagatgagatcaaggcaggaatacagcgaagatcaatttttgtgctataaatcagaaagcggctctggctcatctgtcaagctaaagaagttcaaggttgaatcatgcaagggtgttactacatcatcagcctctaagtgctctggcgatgagtatttctgcagcaggtatccatgtgaaacagccaacgttgaagcccactgcattctaaggaggcatagtgcaatagtggaagtgaatgtcaacggcgtgtgggttgtgcctaggtgtattggctatgaggaggttctggtcaaaaggacatcactcaaggttgaagatacgacaggaagggaatgtgattcctgcttatgggaatgtgggaagaataagctgattgtcaagactcatggtcccaaagtggtttatgcaacagcatgcagccatggatcctgtaaaagtgtgatgcagaagccagcaacctttgtgtacctgccataccctggaaatagtgaaattgttgggggtgacatagggattcacatgacagaagagtcatcaccctcgaatatacacttagtagcacactgccctgcaagggactcatgtgatgtcagtgactgtctattctgcgttcacggactccttaattatcagtgccacaccttgttttcagcattgctcatatcaactactgtgatgtcaattctcacattgctgctcttgcttgtgaaaggggcaaaggatcttgttaagaaattgttctactggctgatcactcctttatgctggctatcagtcttttgctgctgggtggttaaaagctggaaaagaagagtgggttcagcaatttctaggacaaacgacactattggttggcgtgaaaacaggcggcatgctcaagacattgagagagcacagtacacaggaggggctccaggggccaaatattcattttatggggttatgattctaggattactgagtagtgcccagagttgctctgaaagtgtgatagcagactccaagatcatgcaatgcacaacctcagggagttccaccctttgcaaggcaagcgggacagtaatcatgagattgggacccataggctcagagtcttgtttgattctgaaagggctcaaggacagtgaaaagcagttcatatctatcaagaccatatcaagtgaactcacgtgccgagaaggagaatctttctggaccaccctatacacacctatctgcttaagctcaagaagatgtcacttgatgggagaatgtgtctctgatcgctgcctcaagtggaagactaatcaaacatccgcagaattcacaggaaaagcacatggtgacgttatgcacgagaacagatgctttgagcaaagtggaggaataggctacggatgttttaacgtaaacccttcttgtctctatgtccactcttatctcaagtctgtttacaggaacgggttcaaggttttcaggtgtgtggcatggaatcataggattagactagaggtgacgacacactcccgaaagttccctatggttttgatggccatgagtacacagcccactgactggggatccattggtttgattcttgactcagaagggataacaggaacaaattcttattcctttatgaaacatggctcaggaagttttgctataatagatgacccatattctccagagcctcgaaaagggttcctgggagaagtgcggtgtcctacagaagagacagccatgcgagcatcaccttcttgcaagatggctccaaacttgattgagtatcagcctgaaatggacacagcagagtgtaccacaaatatgatagaccctatggctatattcaatcgaggatctctgccacaggttcgggatgggatgactttcacgcaatcaatagaaaagaacactgttcaggcattaacaacaggggaagttaaggcatccatccgcctcatattagatgattatgatgtggtgtatcaaaatagccagtctgactgctcagccacattcaagaacctcactggttgttactcatgtgatgaaggatccagactatgctatcaagtgaaggcagaaggcgagactatttttcactttatcaatgaagaagagtccatcaatgtcatcaataaggtaagcccgggagtgagcgactactgcaccgttctccatttctcaaggcctgttatttctattgagggaacatatgactgcgggctaagcaagagaccaatggtgataaaaggtactctaattgccactgctccacatgatgatagaaagcatgaaggaggttcttctttagtagtcaaccccaaaggtggttcagttgacttctttggatggttgtctggattgacctcatggctcggaggtcctctcaaaacatttctgactattcttggattcctagctgtgggcttactgttggtggtgataattatcatcatcattcggactggaatgcaacaagctttgaagaagaagataaaataa

SEQ ID NO: 4692 - RNA, 3222 nt, synthetic construct
  misc_feature 1..3222: note = derived and/or modified CDS sequence (wt) from SFTSV(HB29)__NC_018138.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggacgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgcagagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaatagcactgcccatgttagatgcaaaggggatgagactgcattcagtgtcttggagggagtccatagctacattgtccgcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4693 - RNA, 3222 nt, synthetic construct
  misc_feature 1..3222: note = derived and/or modified CDS sequence (wt) from SFTSV(Jilin)__KT890281.1__GP
  source 1..3222: mol_type = other RNA
atgatgaaagtcatctggttctcctctctgatctgcttagtcattcaatgcggtggggatacgggcccaatcatctgtgcaggacccatccactcaaacaagagtgctaacataccccacctgcttggctactctgagaagatttgtcagatagatcggctgatacatgtttcgtcatggctcagaaaccactcacaatttcagggctacgtagggcagcgaggtggacgctctcaggtgagctactacccggctgaaaattcttactcaaggtggagtggacttctaagcccctgtgatgctgattggcttgggatgcttgtcgtgaagaaggccaaggggtctgatatgatagttcctgggccctcatacaaggggaaagtcttttttgaacggccaacttttgatggatacgtaggctggggctgtggtagtgggaagtctaggactgagtcaggtgagctctgcagttcagactccgggactagctctggtcttctgccctcggatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcgtggatggatgttggccactctcataaaatcatcatgagggagcacaagaccaagtgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagcccggggaagtcgttgtgtcatatggagggatgcgtgtcagaccaaaatgctatggtttctccagaatgatggcaccactggaggtgaacccaccagagcaaaggattggtcaatgtactggctgccatctagaatgcataaatgggggtgtgaggctaatcactttaaccagtgagctcaagtcagctactgtctgcgcttatcacttttgtagttgtgccacaagtggtaagaaaagcacggagattcaattccactcaggatcattggttggaaaaacagcaatccacgtcaaaggggcattggtagatggaactgaattcacatttgagggtagatgcatgttcccagatggttgtgatgcagtggactgcacattctgtcgtgagtttctaaaaaatcctcagtgctaccctgcacagaagtggctgttcatcattattgtcatcctcctaggatatgcaggcctcatgctactcaccaatgttcttaaggcaatgggggtttgggggtcatgggtcatagctccagtgaagctagtgtttgccatcataaagaaactaatgagagctgtgagctgcctgatggggaaattgatggataggggaaggcaagtgatccatgaggaaataggggagaatagagagggcaaccaagatgatgttaggatcgagatggccagacccaggagggtaaggcattggatgtactcacctgtcatccagactattgtagcaatagggcttgctgagggctgtgatgagatggtccatgctgattctaaacttgtttcgtgcaggcaggggagcggaaatatgaaggaatgtgtcacaactgggagggcgcttcttcctgcggtgaacccaggtcaagaggcgtgtctgcacttcacggcacctgggagtccggactcaaaatgtctcaaaattagggttaagaggatcaacctaaaatgtaagaagtcatcatcatattttgttcctgatgcccggtccagatgtacatcagtgaggagatgtcgttgggctggagactgccagtctgggtgcccccctcatttcacatccaattccttttctgatgattgggcaggtaagatggacagggctggtctaggattcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgagaacattccaccccatgagtggcatccccacacaagtcttcaagggtgtgagtgtaacttacttgggctcagatatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgcaccataaaaaaagatgggtgcatatggaatgcagacctcgtgggtatagagctacgagtggatgacgctgtgtgttactccaagatcactagtgtggaggcagttgcaaactactctgccatacccaccactattggggggctgaggtttgagagaagccatgacagccagggtaaaatatctggtagccccctggacatcacagctataagaggatctttttctgtcaattatagaggccttcgactgagtctctcagaaattactgctacgtgtacaggggaagtgacaaatgtgagtgggtgttattcatgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtctttgtttaagctgggaacaaaacagatatttcgatcgaggacaaagctggcttag

SEQ ID NO: 4694 - RNA, 3222 nt, synthetic construct
  misc_feature 1..3222: note = derived and/or modified CDS sequence (wt) from SFTSV(05-Lu'an(CHN)-2015)__KX302597.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctggagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcagtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatgtttgccatcataaagaaactaatgagaactgtgagctacttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgcttcaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggttcatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4695 - RNA, 3222 nt, synthetic construct
  misc_feature 1..3222: note = derived and/or modified CDS sequence (wt) from SFTSV(07-Lu'an(CHN)-2015)__KX302598.1__GP
  source 1..3222: mol_type = other RNA
atgatgaaagtcatctggttctcctctctgatctgcttagtcattcaatgcagtggggactcgggtccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaaccctccagagcaaaggattggtcaatgcactggctgccatctagaatgcataaatgggggtgtgaggctaatcactctaaccagtgagctcaggtcagctactgtctgtgcttcccacttttgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggagggcgcttcttcctgcggtgaacccagggcaagaggcatgtctgcacttcacagcacctgggagtccggactcaaaatgtctcaaaattaaggtcaagaggatcaacctaaaatgtaagaagtcatcatcatattttgttccagatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaatgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagttgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4696 - RNA, 3222 nt, synthetic construct
  misc_feature 1..3222: note = derived and/or modified CDS sequence (wt) from SFTSV(12-Lu'an(CHN)-2014)__KX302595.1__GP
  source 1..3222: mol_type = other RNA
atgatgaaagtcatctggttctcctctctgatctgcttagtcattcaatgcagtggggatacaggcccaatcatatgcgcagggcccatccactcgaacaagagtgccaacataccccacctgcttggttactctgagaagatttgtcagatagatcggctgatacatgtttcgtcatggctgagaaaccattcacaatttcagggctacgtggggcagcgaggtggtcgctctcaggtgagttactacccagctgaaaactcttactcaaggtggagtggacttctaagcccctgtgatgctgattggcttgggatgcttgtcgtgaagaaggccaaggggtctgatatgatagttcctgggccttcatacaaggggaaggtcttttttgaacggccaacttttgatggatacgtgggctggggctgtggcagtgggaagtcaaggactgagtcaggtgaactctgcagctcagactcagggaccagttctggtcttctgccgtcagatagggttctctggataggtgatgtggcttgtcagcccatgacacccatccctgaggagacatttttggagctgaagagttttagccagagtgaattcccagacatatgcaaagttgatggcattgtgttcaaccagtgtgatagtgagagtctacctcagcccattgatgtcgcatggatggatgtaggtcactctcataagatcatcatgagggagcacaagaccaaatgggtacaagagagctcatcaaaagattttgtgtgctacaaggaagggactgggccatgttctgaatcggaagaaaagacttgtaagaccagtggatcatgcaggggggacatgcagttttgcaaggtggcaggttgtgaacatggggaagaggcatctgaagccaagtgtagatgctcactagtgcataagcccggggaagttgttgtatcatatggagggatgcgtgtcagaccaaagtgttatggtttttccagaatgatggcaacactagaggtgaaccctccagagcaaagaattggccaatgcactggctgccatctagaatgcataaatgggggtgtgaggctaatcactctaactagcgagctcaagtcagctactgtctgtgcttcccacttttgtagttctgccacaagtggcaagaaaagcacggagattcaattccactcagggtcattggttgggaaagcagcaatacacgtcaaaggggctttggtggatggaactgaattcacatttgagggcagttgcatgttcccagatggttgtgacgcagtggactgcacattctgtcgtgagtttctaaaaaatccgcagtgctaccctgcaaagaaatggttgttcattattattgtcatcctccttggatatgcaggcctcatgctactcaccaatgtccttaaggcaatcggggtttggggatcatgggtcatggctccagtgaagctaatgtttgccatcatgaagaaactgatgagatctgtgagctgcttgatgggaaaattgatggataggggaaggcaagtgatccatgaagaaataggggagaatagagagggcaaccaagatgatgttaggatcgagatggcaagacccagaagggtgaggcattggatgtactcacctgtcatcctgactattctagcaattgggcttgctgagggctgcgatgagatggtccatgcagattctaaacttgtttcgtgcagacaagggagcggaaatatgaaggaatgtgtcacaactgggagggcactccttcctgcggtgaacccaggacaagaggcatgtctgcacttcacggcacctgggagtccggactcaaaatgtctcaaaatcaaggttaagaggatcaacctaaaatgtaagaagtcatcatcatattttgttcctgatgctcggtccaggtgtacatctgtgaggagatgtcgctgggcaggagactgtcagtctggttgcccctcttatttcacgtccaactccttctctgatgattgggcaggtaaaatggacagggctggtctaggattcagtggctgctctgatggatgtggaggagcagcctgcggctgctttaatgcggccccttcatgcatcttctggaggaaatgggtagagaatccacatgggatcatctggaaagtatccccatgtgctgcatgggtcccttcagcagtcatagagctgacaatgccctcgggggaagtgaggacattccaccccatgagcggcatccccacacaagtcttcaagggtgtgagtgtgacttacttaggctcagatatggaggtgtctggcttgactgacctgtgtgagatagaagagctcaagtccaagaagctggcattggctccctgcaatcaggctggcatgggggtagtaggcaaggttggagagatacagtgtagcagcgaggaaagtgcccgtaccataaagaaagatgggtgtatatggaatgctgaccttgtgggcatagagctacgagtggatgacgctgtgtgctactctaagatcactagtgtggaggcagttgcaaactactctgccatacccaccactattggagggctaaggtttgagagaagccatgacagccagggtaaaatatctggtagccccctagacatcacagccataagagggtctttttcggttaattatagaggccttcgactgagcctctcagaaattactgctacttgcacaggagaggtgacgaatgtgagtgggtgttactcttgcatgacaggcgccaaagtctccatcaaactgcatagcagcaaaaatagcactgcccatgtaagatgcagaggggatgagactgcgttcagtgtcctggaaggagttcatagctatactgtcagtctcagctttgaccatgcagtggtcgatgagcagtgccagctgaactgtggggggcatgagagtcaagtgactctaaaaggcaacctcatcttcctggatgtcccaaaatttgtagatggcagctatatgcagacatatcatagttctgtgcccacaggggctaatatcccaagccctacagactggctgaatgccttgtttggcaatgggctgagtaggtggattctgggggtgataggggttctactgggggtattggctctcttcttcttaatcatgtctttgttcaaactgggaacaaaacaggtaattcgatcaaggacgaagctggcttag

SEQ ID NO: 4697 - RNA, 3222 nt, synthetic construct
  misc_feature 1..3222: note = derived and/or modified CDS sequence (wt) from SFTSV(14-Lu'an(CHN)-2014)__KX302596.1__GP
  source 1..3222: mol_type = other RNA
atgatgaaagtcatctggttctcctctctgatctgcttagtcattcaatgcagtggggatacaggcccaatcatatgcgcagggcccatccactcgaacaagagtgccaacataccccacctgcttggttactctgagaagatttgtcagattgatcggctgatacatgtttcgtcatggctgagaaaccattcacaatttcagggctacgtggggcagcgaggtggtcgctctcaggtgagttactacccagctgaaaactcttactcaaggtggagtggacttctaagcccctgtgatgctgattggcttgggatgcttgtcgtgaagaaggccaaggggtctgatatgatagttcctgggccttcatacaaggggaaggtcttttttgaacggccaacttttgatggatacgtgggctggggctgtggcagtgggaagtcaaggactgagtcaggtgaactctgcagctcagactcagggaccagttctggtcttctgccgtcagatagggttctctggataggtgatgtggcttgtcagcccatgacacccatccctgaggagacatttttggagctgaagagttttagccagagtgaattcccagacatatgcaaagttgatggcattgtgttcaaccagtgtgatagtgagagtctacctcagcccattgatgtcgcatggatggatgtaggtcactctcataagatcatcatgagggagcacaagaccaaatgggtacaagagagctcatcaaaagattttgtgtgctacaaggaagggactgggccatgttctgaatcggaagaaaagacttgtaagaccagtggatcatgcaggggggacatgcagttttgcaaggtggcaggttgtgaacatggggaagaggcatctgaagccaagtgtagatgctcactagtgcataagcccggggaagttgttgtatcatatggagggatgcgtgtcagaccaaagtgttatggtttttccagaatgatggcaacactagaggtgaaccctccagagcaaagaattggccaatgcaccggctgccatctagaatgcataaatgggggtgtgaggctaatcactctaactagcgagctcaagtcagctactgtctgtgcttcccacttttgtagttctgccacaagtggcaagaaaagcacggagattcaattccactcagggtcattggttgggaaagcagcaatacacgtcaaaggggctttggtggatggaactgaattcacatttgagggcagttgcatgttcccagatggttgtgacgcagtggactgcacattctgtcgtgagtttctaaaaaatccgcagtgctaccctgcaaagaaatggttgttcattattattgtcatcctccttggatatgcaggcctcatgctactcaccaatgtccttaaggcaatcggggtttggggatcatgggtcatggctccagtgaagctaatgtttgccatcatgaagaaactgatgagatctgtgagctgcttgatgggaaaattgatggataggggaaggcaagtgatccatgaagaaataggggagaatagagagggcaaccaagatgatgttaggatcgagatggcaagacccagaagggtgaggcattggatgtactcacctgtcatcctgactattctagcaattgggcttgctgagggctgcgatgagatggtccatgcagattctaaacttgtttcgtgcagacaagggagcggaaatatgaaggaatgtgtcacaactgggagggcactccttcctgcggtgaacccaggacaagaggcatgtctgcacttcacggcacctgggagtccggactcaaaatgtctcaaaatcaaggttaagaggatcaacctaaaatgtaagaagtcatcatcatattttgttcctgatgctcggtccaggtgtacatctgtgaggagatgtcgctgggcaggagactgtcagtctgggtgcccctctcatttcacgtccaactccttctctgatgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccttcagcagtcatagagctgacaatgccctcgggggaagtgaggacattccaccccatgagcggcatccccacacaagtcttcaagggtgtgagtgtgacttacttaggctcagatatggaggtgtctggcttgactgacctgtgtgagatagaagagctcaagtccaagaagctggcattggctccctgcaatcaggctggcatgggggtagtaggcaaggttggagagatacagtgtagcagcgaggaaagtgcccgtaccataaagaaagatgggtgtatatggaatgctgaccttgtgggcatagagctacgagtggatgacgctgtgtgctactctaagatcactagtgtggaggcagttgcaaactactctgccatacccaccactattggagggctaaggtttgagagaagccatgacagccagggtaaaatatctggtagccccctagacatcacagccataagagggtctttttcggttaattatagaggccttcgactgagcctctcagaaattactgctacttgcacaggagaggtgacgaatgtgagtgggtgttactcttgcatgacaggcgccaaagtctccatcaaactgcatagcagcaaaaatagcactgcccatgtaagatgcagaggggatgagactgcgttcagtgtcctggaaggagttcatagctatactgtcagtctcagctttgaccatgcagtggtcgatgagcagtgccagctgaactgtggggggcatgagagtcaagtgactctaaaaggcaacctcatcttcctggatgtcccaaaatttgtagatggcagctatatgcagacatatcatagttctgtgcccacaggggctaatatcccaagccctacagactggctgaatgccttgtttggcaatgggctgagtaggtggattctgggggtgataggggttctactgggggtattggctctcttcttcttaatcatgtctttgttcaaactgggaacaaaacaggtatttcgatcaaggacgaagctggcttag

SEQ ID NO: 4698 - RNA, 3222 nt, synthetic construct
  misc_feature 1..3222: note = derived and/or modified CDS sequence (wt) from SFTSV(18-Lu'an(CHN)-2015)__KX302599.1__GP
  source 1..3222: mol_type = other RNA
atgatgaaagtcatctggttcttctctctgatctgctttgtcattcaatgcagtggggattcaggcccaatcatctgcgcaggacccatccactcaaacaagagtgctgacatacctcacctgctgggttattctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctgagcccctgtgatgctgattggcttgggatgcttgtcgtgaagaaggccaaggggtctgatatgatagtccctgggccttcatacaagggaaaagtcttttttgaacggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgtaggggagacatgcagttctgcaaggtggcaggttgtgaacatggggaagaggcatctgaagccaagtgcagatgctcacttgtgcacaagcccggagaagtcgttgtgtcatatagagggatgcgtatcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagcggcaagaaaagcacggagattcaattccactcaggatcattggttgggaaaacagcaatacacgtcaaaggggcattggtggatggaactgaattcacatttgagggtagttgcatgttcccagatggttgtgatgcggtggactgcactttctgtcgtgagtttctaaaaaatccccagtgctaccctgctaagaaatggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggatcgagatggcaagacccagaagggtaaggcattggatgtactcacctgtcatcctgaccattttagcaatagggcttgctgagggctgtgatgagatggtccatgctgattctaagcttgtttcatgcaggcaagggagcggaaatgtgaaggaatgtgtcacaactgggagggcgcttcttcctgcggtgaacccaggtcaagaggcgtgtctgcacttcacggcacctgggagtccggactcaaaatgtctcaaaattagggttaagaggatcaacctaaaatgtaagaagtcatcatcatattttgtccctgatgcccggtccagatgtacatcagtgaggagatgtcgttgggctggagactgccagtctgggtgcccccctcatttcacatccaattccttttctgatgattgggcaggtaagatggacagggctggtctaggattcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgagaacattccaccccatgagtggcatccccacacaagtcttcaagggtgtgagcataacttacttgggctcagatatggaggtgtctggcttgactgacctatgtgagatagaggagctcaagtctaagaagctggcattagctccctgcaaccaggctggcatgggggttgtaggcaaggttggagagatacagtgcagtagcgaggaaagtgcccgtaccataaaaaaagatgggtgcatatggaatgcagacctcgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagccataagagggtctttttctgttaattatagaggccttcgactgagtctctcagaaattactgcaacctgcacaggggaggtgacaaatgtgagtgggtgttattcttgcatgacaggcgccaaagtctctatcaaactgcatagcaacaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcacagcactgtgcccacaggggcaaatatcccaagccctacagactggctgaatgccttgtttggcaatgggctgagtaggtggatcctgggggtgataggggttctgcttgggggattggctctctttttcatgatcatgtctttgttcaagctgggaacaaaacaggtatttcgatcaaggacgaagctggcttag

SEQ ID NO: 4699 - RNA, 3222 nt, synthetic construct
  misc_feature 1..3222: note = derived and/or modified CDS sequence (wt) from SFTSV(27-Lu'an(CHN)-2015)__KX302600.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccatcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtatcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtaacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatactttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtaagtggatgttattcttgcatgacaggcgccaaagtctctatcaaactacatagcagcaaaaatagcactgcccatgtaagatgcaaaggggatgagactgcattcagtgtcttggagggggttcatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4700 - RNA, 3222 nt, synthetic construct
  misc_feature 1..3222: note = derived and/or modified CDS sequence (wt) from SFTSV(36-Lu'an(CHN)-2015)__KX302601.1__GP
  source 1..3222: mol_type = other RNA
atgatgaaagtcatctggttctcctctctgatctgttttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcaggaactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatgtttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcgtcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggttcatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4701 - RNA, 3222 nt, synthetic construct
  misc_feature 1..3222: note = derived and/or modified CDS sequence (wt) from SFTSV(42-Lu'an(CHN)-2015)__KX302602.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcatctgctgggtttctccgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcaacctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggaaggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagctccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagtttcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaagctacatagcagcaaaaatagcactgcccatgtaagatgcaaaggggatgagactgcattcagtgtcttggagggggttcatagctacactgtcagtctcagttttgaccatgctgtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4702 - RNA, 3222 nt, synthetic construct
  misc_feature 1..3222: note = derived and/or modified CDS sequence (wt) from SFTSV(44-Lu'an(CHN)-2015)__KX302603.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcatctgctgggtttctccgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcaacctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagctccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagtttcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaagctacatagcagcaaaaatagcactgcccatgtaagatgcaaaggggatgagactgcattcagtgtcttggagggggttcatagctacactgtcagtctcagttttgaccatgctgtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4703 - RNA, 3222 nt, synthetic construct
  misc_feature 1..3222: note = derived and/or modified CDS sequence (wt) from SFTSV(52-Lu'an(CHN)-2015)__KX302604.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgttctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactctgggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgagcatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacagagattcaattccactcagggtcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaggtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4704 - RNA, 3222 nt, synthetic construct
  misc_feature 1..3222: note = derived and/or modified CDS sequence (wt) from SFTSV(HL/Injected)__KF791953.1__GP
  source 1..3222: mol_type = other RNA
atgatgaaagtcatctggttctcctctctgatctgcttagtcattcaatgcggtggggatacgggcccaatcatctgcgcaggacccatccactcaaacaagagtgctgacataccccacctgcttggctactctgagaagatttgtcagatagatcggctgatacatgtttcgtcttggcttagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactccgggactagttctggtcttctgccctcggatagggttctctggataggtgatgttgcttgtcagccaatgacacccatccctgaggagacatttctggagctgaaaagctttagccaaagtgaattcccagacatatgcaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctaatcactctaaccagtgagctcaagtcagctactgtctgcgcttctcacttttgcagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctggcaatagggcttgctgagggctgtgatgagatggtccatgctgattctaaacttgtttcgtgcaggcaggggagcggaaatatgaaggaatgtgtcacaactgggagggcgcttcttcctgcggtgaacccagggcaagaggcgtgtctgcacttcacggcacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggtatagagctacgggtggatgacgctgtgtgctactctaagatcactagtgtggaggcagttgcaaactactccgccatacccaccactattggggggctgaggtttgagagaagccatgacagccagggtaaaatatctggtagccccctggacatcacagctataagaggatctttttctgtcaattatagaggccttcgactgagtctctcagaaatcactgctacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtctttgtttaagctgggaacaaaacagatatttcgatcgaggacaaagctggcttag

SEQ ID NO: 4705 - RNA, 3222 nt, synthetic construct
  misc_feature 1..3222: note = derived and/or modified CDS sequence (wt) from SFTSV(HL/Larvae/G2)__KF791955.1__GP
  source 1..3222: mol_type = other RNA
atgatgaaagtcatctggttctcctctctgatctgcttagtcattcaatgcggtggggatacgggcccaatcatctgcgcaggacccatccactcaaacaagagtgctgacataccccacctgcttggctactctgagaagatttgtcagatagatcggctgatacatgtttcgtcttggcttagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactccaggactagttctggtcttctgccctcggatagggttctctggataggtgatgttgcttgtcagccaatgacacccatccctgaggagacatttctggagctgaaaagctttagccaaagtgaattcccagacatatgcaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctaatcactctaaccagtgagctcaagtcagctactgtctgcgcttctcacttttgcagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctggcaatagggcttgctgagggctgtgatgagatggtccatgctgattctaaacttgtttcgtgcaggcaggggagcggaaacatgaaggaatgtgtcacaactgggagggcgcttcttcctgcggtgaacccagggcaagaggcgtgtctgcacttcacggcacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggtatagagctacgggtggatgacgctgtgtgctactctaagatcactagtgtggaggcagttgcaaactactccgccatacccaccactattggggggctgaggtttgagagaagccatgacagccagggtaaaatatctggtagccccctggacatcacagctataagaggatctttttctgtcaattatagaggccttcgactgagtctctcagaaatcactgctacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtctttgtttaagctgggaacaaaacagatatttcgatcgaggacaaagctggcttag

SEQ ID NO: 4706 - RNA, 3222 nt, synthetic construct
  misc_feature 1..3222: note = derived and/or modified CDS sequence (wt) from SFTSV(JS2011-004)__KC505124.1__GP
  source 1..3222: mol_type = other RNA
atgatgaaagtcatctggttctcctctctgatctgcttagtcattcaatgtggtggggatacaggcccaatcatctgcgcaggacccatccactcaaacaagagtgctgacatacctcacctgcttggctactctgagaagatttgtcagatagatcggctgatacatgtttcgtcatggcttagaaaccactcacaatttcagggctacgtagggcagcgaggtggacgctctcaggtgagctactacccagctgaaaattcttactcaaggtggagtggacttctaagcccctgtgatgctgattggcttgggatgcttgtcgtgaagaaggccaaggggtctgatatgatagttcctgggccttcatacaaggggaaagtcttctttgaacggccaacttttgatggatacgttggctggggctgtggcagtgggaagtctaggactgagtcaggtgagctctgcagttcagactctgggactagttctggtcttctgccctcggatagggttctctggataggtgatgttgcttgtcagcctatgacacccatccctgaggagacatttctggagctgaagagctttagccaaagtgaattcccagacatatgcaagattgatggcattgtgttcaaccagtgtgggggtgagagtctacctcagccctttgatgttgcatggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagcccggggaagtcgttgtgtcatatggagggatgcgtgtcagaccaaagtgctatggtttctccagaatgatggcaacactggaggtgaaccaaccagagcaaaggattggtcaatgcactggctgccatctagaatgcataaatgggggtgtgaggctaatcactctaaccagtgagctcaagtcagctactgtctgcgcttctcacttttgtagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctactcaccaatgttcttaaggcaattggggtttggggatcatgggtcatagctccagtgaagctagtgtttgccatcatgaagaaactaatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaaggaagcggaaatatgaaggaatgtgtcacaactgggagggcgcttcttcctgcggtgaacccagggcaagaggcgtgtctgcacttcacggcacctggaagtccagactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtctctccatgtgccgcatgggtcccatcagcagttatagagctaacaatgccctcaggggaggtgaggacattccaccccatgagcggaatccccacacaagtcttcaagggtgtgagtgtaacttacttgggctcagatatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggcatagagctacgagtggatgacgctgtgtgttactctaagatcactagtgtggaggcagttgcaaactactctgctatacccaccactattggggggctgaggtttgagagaagccatgacagccagggtaaaatatctggtagccccctggacatcacagctataagaggatctttttctgtcaattatagaggccttcgactgagtctctcagaaattacagctacgtgtacaggggaagtgacaaatgtgagtgggtgttattcatgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtggggggcatgagagtcatgttactctgaaaggtaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggtgtgataggggtcctactggggggattggctctctttttcttgatcatgtctttgttcaagctgggaacaaaacaggtatttcgatcgaggacgaagctggcttag

SEQ ID NO: 4707 - RNA, 3222 nt, synthetic construct
  misc_feature 1..3222: note = derived and/or modified CDS sequence (wt) from SFTSV(JS2011-013-1)__KC505127.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaagccaaggggtctgatatgatagttcctgggccttcatacaaggggaaagtcttttttgagcggccaacttttgatggatatgtaggctggggctgtggtagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggagaagaggcatctgaagccaagtgtagatgctcacttgtacacaagcccggagaagtcgttgtgtcatatggagggatgcgtgtcagaccaaagtgctatggtttctccagaatgatggcaacactggaggtgaaccaaccagagcaaaggcttggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactgtgagctgcttgatgaggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatggaatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgttactctaaaatcactagtgtggaagcagttgcaaactactctgccatacccaccactattggggggctgaggtttgagagaagccatgacagccagggtaaaatatctggtagccccctggacatcacagctataagaggatctttttctgttaaatatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagactgcattcagtgtcttggagggaggtcatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagcaggtggatcctgggggtgataggggttctgcttggggggttggctctctttttcatgattatgtctttgttcaagctgggaacaaaacaggtatttcgatcaaggacaaagctggcttag

SEQ ID NO: 4708 - RNA, 3222 nt, synthetic construct
  misc_feature 1..3222: note = derived and/or modified CDS sequence (wt) from SFTSV(JS2011-027)__KC505130.1__GP
  source 1..3222: mol_type = other RNA
atgatgaaagtcatctggttctcctctctgatctgcttagtcattcaatgcggtggggatacaggcccaatcatctgcgcaggacccatccactcaaacaagagtgctgacataccccacctgcttggctactctgagaagatttgtcagatagatcggctgatacatgtttcgtcatggcttagaaaccactcacaatttcagggctacgtagggcagcgaggtggacgatctcaggtgagctactacccagctgaaaattcttactcaaggtggagtggacttctaagcccctgtgatgctgattggcttgggatgcttgtcgtgaagaaggccaaggggtctgacatgatagttccagggccttcatacaaggggaaagtcttttttgaacggccaacttttgatggatacgtaggctggggctgtggcagtgggaagtctaggactgagtcaggtgagctctgcagttcagactccgggactagttctggtcttctgccctcagatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtacaagagagctcatccaaggattttgtgtgctacaaggaagggactggaccttgttctgaatcagaagaaaagacttgcaagaccagtggatcatgcaggggggacatgcagttttgcaaggtggcaggttgtgaacatggggaagaggcatctgaagccaagtgcagatgctcacttgtgcacaagcccggggaagtcgttgtgtcatatggagggatgcgtgtcagaccaaagtgctatggtttctccagaatgatggcaacactggaggtgaacgaaccagagcagaggattggtcaatgcactggctgccatctagaatgcataagtgggggtgtgaggctaatcactctaaccagtgagctcaagtcagctactgtctgcgcttctcacttctgtagttctgccacaagtggtaagaaaagcacggagattcaattccactcaggatcattggttgggaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctactcaccaatgttcttaaggcaattggggtttggggatcatgggtcatagctccagtgaagctagtgtttgccatcataaagaaactaatgagagctgtgagctgcctgatggggaaattgatggatagaggaaggcaagtgatccatgaggaaataggggagaatagagagggcaaccaagatgatgttaggattgagatggccagacccaggagggtaaggcattggatgtactcgcctgtcatcctgactattctagcaatggggcttgctgagggctgtgatgagatggtccatgctgattctaaacttgtttcgtgcaggcaagggagcggaaatatgaaggaatgtgtcacaactgggagggcgcttcttcctgcagtgaacccagggcaagaggcgtgtctgcacttcacggcacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgtggttgctttaatgcggccccttcttgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgacctgtgtgagatagaagagctcaagtcaaagaagcttgctttagctccctgcaaccaggctggtatgggggttgtaggcaaggttggagagatacagtgcagtagcgaggaaagtgcccgtaccataaaaaaagatgggtgcatatggaatgcagaccttgtgggtatagagctacgggtggatgacgctgtgtgctactctaagatcactagtgtggaggcagttgcaaactactccgccatacccaccactattggggggctgaggtttgagagaagccatgacagccagggcaaaatatctggtagccccctggacatcacagctataagaggatctttttctatcaattatagaggccttcgactgagcctctcagaaattactgctacttgcacaggggaagtgacaaatgtgagtgggtgttattcttgcatgacaggcgccaaagtctccatcaagttgcatagcagcaaaaatagcactgcccatgtaagatgcaaaggggatgagactgcattcagtgtcttggagggagtccatagctactctgtcagtctcagttttgatcatgcagtagttgatgagcagtgccaactgaactgtgggggacatgagagccaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtaggtggatcctgggggtgataggggtcctactggggggattggctctctttttcttgatcatgtctttgttcaagctgggaacaaaacaggtatttcgatcgaggacgaagctggcttaa

SEQ ID NO: 4709 - RNA, 3222 nt, synthetic construct
  misc_feature 1..3222: note = derived and/or modified CDS sequence (wt) from SFTSV(JS2011-034)__KC505133.1__GP
  source 1..3222: mol_type = other RNA
atgatgaaagtcatctggttctcctctctgatctgctttgtcattcaatgcagtggggactcgggcccaatcatctgtgcaggacccatccactcaaataagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaggccaaggggtctgatatgatagtccctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgtaaggtagcaggttgtgaacatggggaagaggcatctgaagccaagtgtagatgctcacttgtacacaagcccggagaagtcgttgtgtcatatggagggatgcgtatcagaccaaagtgctatggtttctccagaatgatggcaacactggaggtgaaccaaccagagcaaaggattggccaatgcactggctgccatctggaatgcataaatgggggtgtgaggctaataaccctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattggaatttggggatcatgggtcatagctccagtgaagctaatgtttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctaacttttttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcgcctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagttgctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgctactctaagatcactagtgtggaagcagttgcaaactactctgctatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggtagctacatgcagacatatcatagcactgtgcccacaggggcaaatatcccaagcccaacagactggctgaatgccttgtttggcaatgggctgagcaggtggatcctgggggtgataggggttctgcttggggggttggctctctttttcatgattatgtctttgctcaagctgggaacaaaacaggtatatcgatcaaggacaaagctggcttag

SEQ ID NO: 4710 - RNA, 3222 nt, synthetic construct
  misc_feature 1..3222: note = derived and/or modified CDS sequence (wt) from SFTSV(JS2011-062)__KC505136.1__GP
  source 1..3222: mol_type = other RNA
atgatgaaagtcatctggttctcctctctgatctgcttagtcattcaatgcagtggggactcgggcccaatcatctgcgcaggacccatccactcaaacaagagtgctgacatacctcacctgcttggttactctgagaagatttgtcagatagatcggctgatacatgtttcgtcatggctcaggaaccactcgcaatttcagggctatgtaggacagcgaggtggacgctctcaggtgagctactacccagctgtgaattcttactcaaggtggagtggacttctaagcccctgtgatgctgattggcttgggatgcttgtcgtgaagaaagccaaggggtctgatatgatagttcctgggccttcgtacaaggggaaagtcttttttgaacggccaacttttgatggatatgtaggctggggctgtggcagtgggaagtctaggactgagtcaggagagctctgcagttcagactcagggactagttctggtcttctgccctcgaatagggttctctggataggtgatgttgcttgtcagcctatgacacccatcccagaggagacatttctggagctgaagagttttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtgcaagagagctcatccaaagattttgtgtgctataaggaagggactgggccttgttctgaatcagaagaaaaggcttgcaagaccagtggatcatgcaggggggacatgcagttttgcaaggtggcaggttgtgaacatggggaggaggcatctgaagccaagtgtagatgctcacttgtgcacaaacccggggaagtcgtagtgtcatatggagggatgcgtgtcagaccaaagtgctatggtttctccagaatgatggcaacactggaggtgaatccaccagagcaaaggattggtcaatgcactggctgccatctagaatgcataaatgggggtgtgaggctaatcactctaaccagtgagctcaagtcagctactgtctgtgcttcccacttttgcagttctgccacaagtggtaagaaaagcacagagattcaattccactcaggatcattggtcgggaaaacagcaatccatgttaaaggggcattggtagatggaactgaattcacatttgagggtagttgcatgttcccagatggatgtgatgcagtggactgtacattctgtcgtgagtttctaaaaaatcctcagtgctaccctgccaagaagtggctgttcatcattattgtcatcctccttggatatgcaggcctcatgctactcaccaatgtccttaaggcaattggggtttggggatcatgggtcatagctccagtgaaactaatgttcgccatcatgaagaaactaatgagaactgtgagctgcttgatggggaaattgatagataggggaaggcaagtgatccatgaggaaataggagagaatggggagggcaaccgagatgatgttaggattgagatggcaagacccagaagggtaaggcattggatgtactcacctgtcatcctgaccattctagcaataggacttgctgagggctgtgatgagatggtccatgctgattctaaacttgtttcatgcaggcaagggagcggaaatatgaaggaatgtgtcacaactgggagggcgcttcttcctgcggtgaacccaggacaagaggcgtgtctgcacttcacggcacctgggagtccggactcaaaatgtctcaaaattaaggtaaagaggattaacctaaaatgtaagaagtcatcatcatattttgttcctgatgcccggtctaggtgtacatcagtgaggagatgtcgttgggcgggagactgccagtctgggtgcccccctcatttcacatctaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtatctccatgtgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggaaagtgcccgtaccataaaaaaagatgggtgcatatggaatgctgaccttgtgggtatagagctacgagtggatgacgctgtgtgctactctaagatcactagtgtggaggcagttgcaaactactctgccatacccaccactataggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcttgcatgacaggcgccaaagtctccatcaaattgcatagcagcaaaaatagcactgcccatgttagatgcaaaggggatgagactgcattcagtgtcttggagggagtccatagctacactgtcagcctcagctttgaccatgcagtagtcgatgagcagtgccagctgaactgtgggggacatgagagtcaagtgactctaaaaggcaacctcatcttcctggatgtcccaaaatttgtggatggcagctacatgcagacatatcacagtactgtgcccacaggggcaaatatcccaagccctacagattggctgaatgccttgtttggcaatgggctgagtaggtggatcctggggttgataggggtcctattgggggggttggctctctttttcttgatcatgtctttgttcaagctgggaacaaaacaagtatttcgatcgaggacaaagctggcttag

SEQ ID NO: 4711 - RNA, 3222 nt, synthetic construct
  misc_feature 1..3222: note = derived and/or modified CDS sequence (wt) from SFTSV(JS2011-109)__KC505139.1__GP
  source 1..3222: mol_type = other RNA
atgatgaaagtcatctggttctcctctctgatctgcttagtcattcaatgtggtggggatacaggcccaatcatctgcgcaggacccatccactcaaataagagtgctgacatacctcacctgcttggctactctgagaagatttgtcagatagatcggctgatacatgtttcgtcatggcttagaaaccactcacaatttcagggctacgtagggcagcgaggtggacgctctcaggtgagctactacccagctgaaaattcttactcaaggtggagtggacttctaagcccctgtgatgctgattggcttgggatgcttgtcgtgaagaaggccaaggggtctgatatgatagttcctgggccttcatacaaggggaaagtcttctttgaacggccaacttttgatggatacgttggctggggctgtggtagtgggaagtctaggactgagtcaggtgagctctgcagttcagactctgggactagttctggtcttctgccctcggatagggttctctggataggtgatgttgcttgtcagcctatgacacccatccctgaggagacatttctggagctgaagagctttagccaaagtgaattcccagacatatgcaagattgatggcattgtgttcaaccagtgtgagggtgagagtctacctcagccctttgatgttgcatggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagcccggggaagtcgttgtgtcatatggagggatgcgtgtcagaccaaagtgctatggtttctccagaatgatggcaacactggaggtgaaccaaccagagcaaaggattggtcaatgcactggctgccatctagaatgcataaatgggggtgtgaggctaatcactctaaccagtgagctcaagtcagctactgtctgcgcttctcacttttgtagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctactcaccaatgttcttaaggcaattggggtttggggatcatgggtcatagctccagtgaagctagtgtttgccatcataaagaaactaatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcacctgtcatcctgactattctagcaatagggcttgctgagggctgtgatgagatggtccatgctgattctaaacttgtttcgtgcaggcaaggaagcggaaatatgaaggaatgtgtcacaactgggagggcgcttcttcctgcggtgaacccagggcaagaggcgtgtctgcacttcacggcacctggaagtccagactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagcggctgctctgatggatgtggaggagcagcctgcggttgctttaatgcggccccttcatgcattttctggaggaaatgggtagagaatccacatgggatcatctggaaagtctctccatgtgccgcatgggtcccatcagcagttatagagctaacaatgccctcaggggaggtgaggacattccaccccatgagcggaatccccacacaagtcttcaagggtgtgagtgtaacttacttgggctcagatatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggcatagagctacgagtggatgacgctgtgtgttactctaagatcactagtgtggaggcagttgcaaactactctgccatacccaccactattggggggctgaggtttgagagaagccatgacagccagggtaaaatatctggtagccccctggacatcacagctataagaggatctttttctgtcaattatagaggccttcgactgagtctctcagaaattactgctacgtgtacaggggaagtgacaaatgtgagtgggtgttattcatgcatgacaggcgccaaagtctccatcaagttgcatagcagcaaaaatagcactgcccatgtgagatgcaaaggggatgagactgccttcagtgtcttggagggagtccatagctactctgtcagtctcagttttgatcatgcagtagttgatgagcagtgccaactgaactgtggggggcatgagagtcatgtgactctgagaggtaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtctttgttcaagctgggaacaaaacaggtatttcgatcgaggacgaagctggcttag

SEQ ID NO: 4712 - RNA, 3222 nt, synthetic construct
  misc_feature 1..3222: note = derived and/or modified CDS sequence (wt) from SFTSV(JS2011-13-2)__KR230770.1__GP
  source 1..3222: mol_type = other RNA
atgatgaaagtcatctggttctcctctctgatctgcttagtcattcaatgtggtggggatacaggcccaatcatctgcgcaggacccatccactcaaacaagagtgctgacatacctcacctacttggctactctgagaagatttgtcagatagatcggctgatacatgtttcgtcatggcttagaaaccactcacaatttcagggctacgtagggcagcgaggtggacgctctcaggtgagctactacccagctgaaaattcttactcaaggtggagtggacttctaagcccctgtgatgctgattggcttgggatgcttgtcgtgaagaaggccaaggggtctgatatgatagttcctgggccttcatacaaggggaaagtcttctttgaacggccaacttttgatggatacgttggctggggctgtggtagtgggaagtctaggactgagtcaggtgagctctgcagttcagactctgggactagttctggtcttctgccctcggatagggttctctggataggtgatgttgcttgtcagcctatgacacccatccctgaggagacatttctggagctgaagagctttagccaaagtgaattcccagacatatgcaagattgatggcattgtgttcaaccagtgtgagggtgagagtctacctcagccctttgatgttgcatggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagcccggggaagtcgttgtgtcatatggagggatgcgtgtcagaccaaagtgctatggtttctccagaatgatggcaacactggaggtgaaccaaccagagcaaaggattggtcaatgcactggctgccatctagaatgcataaatgggggtgtgaggctaatcactctaaccagtgagctcaagtcagctactgtctgcgcttctcacttttgtagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctactcaccaatgttcttaaggcaattggggtttgggggtcatgggtcatagctccagtgaagctagtgtttgccatcataaagaaactaatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaaggaagcggaaatatgaaggaatgtgtcacaactgggagggcgcttcttcctgcggtgaacccagggcaagaggcgtgtctgcacttcacggcacctggaagtccagactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagcggctgctctgatggatgtggaggagcagcctgcggttgctttaatgcggccccttcatgcattttctggaggaaatgggtagagaatccacatgggatcatctggaaagtctctccatgtgccgcatgggtcccatcagcagttatagagctaacaatgccctcaggggaggtgaggacattccaccccatgagcggaatccccacacaagtcttcaagggtgtgagtgtaacttacttgggctcagatatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgtatatggaatgctgacctcgtgggcatagagctacgagtggatgacgctgtgtgttactctaagatcactagtgtggaggcagttgcaaactactctgccatacccaccactattggggggctgaggtttgagagaagccatgacagccagggtaaaatatctggtagccccctggacatcacagctataagaggatctttttctgtcaattatagaggccttcgactgagtctctcagaaattactgctacgtgtacaggggaagtgacaaatgtgagtgggtgttattcatgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtggggggcatgagagtcatgtaactctgaaaggtaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggtgtgataggggtcctactggggggattggctctctttttcttgatcatgtctttgttcaagctgggaacaaaacaggtatttcgatcgaggacgaagctggcttag

SEQ ID NO: 4713 - RNA, 3222 nt, synthetic construct
  misc_feature 1..3222: note = derived and/or modified CDS sequence (wt) from SFTSV(JS2011-69)__KR230771.1__GP
  source 1..3222: mol_type = other RNA
atgatgaaagtcatctggttctcctctctagtctgcttagtcattcaatgcagtggggacacaggcccaatcatatgcgcagggcccatccactcgaacaagagtgccaacataccccacctgcttggttactctgagaagatttgtcagatagatcggctgatacatgtttcgtcatggctgagaaaccactcacaatttcagggttacgtggggcagcgaggtggacgctctcaggtgagttactacccagctgaaaactcttactcaaggtggagtggacttcttagcccctgtgatgctgattggcttgggatgcttgtcgtgaagaaggccaaggggtctgatatgatagttcctgggccttcatacaaggggaaggtcttttttgaacggccaacttttgatggatacgtgggctggggctgtggcagtgggaagtcaaggactgagtcaggtgaactctgcagctcagactcagggaccagttctggtcttctgccgtcagatagggttctctggataggtgatgtggcttgtcagcccatgacacccatccctgaggagacatttttggagctgaagagttttagccagagtgaattcccagacatatgcaaaattgatggcattgtgttcaaccagtgtgatagtgagagtctacctcagccctttgatgtcgcatggatggatgtaggtcactctcataagatcatcatgagggagcacaagaccaaatgggtacaagagagctcatcaaaagattttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcataagcccggggaagttgttgtgtcatatggagggatgcgtgtcagaccaaagtgttatggtttttccagaatgatggcaacactagaggtgaaccctccagagcaaagaattggccaatgcactggctgccatctagagtgcataaatgggggtgtgaggctaatcactctaactagcgagctcaagtcagctacagtctgtgcttctcacttttgtagttctgccacaagtggcaagaaaagcacggagattcaattccactcagggtcattggttgggaaagcagcaatacacgttaaaggggctttggtggatggaaccgaattcacatttgagggcagttgcatgttcccagatggttgtgacgcagtggactgcacattctgtcgtgagtttctaaaaaatccgcagtgctaccctgcaaagaaatggttgttcattattattgtcatcctccttggatatgcaggcctcatgctactcaccaatgtccttaaggcaatcggggtttggggatcatgggtcatggctccagtgaagctaatgtttgccatcataaagaaactgatgagatctgtgagctgcttgatgggaaaattgatggataggggaaggcaggtgatccatgaagaaataggggagaatagagagggcaaccaagatgatgttaggatcgagatggcaagacccagaagggtgaggcattggatgtactcacctgtcatcctgactattctagcaattgggcttgctgagggctgcgatgagatggtccatgcagattctaaacttgtttcgtgcagacaagggagcggaaatatgaaggaatgtgtcacaactgggagggcactccttcctgcggtgaacccaggacaagaggcatgtctgcacttcacggcacctgggagtccggactcaaaatgtctcaaaatcaaggttaagaggatcaacctaaaatgtaagaagtcatcatcatattttgttcctgatgctcggtccaggtgtacatctgtgaggagatgtcgctgggcaggagactgtcagtctgggtgcccctctcatttcacgtccaactccttctctgatgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccttcagcagtcatagagctgacaatgccctcgggggaagtgaggacattccaccccatgagcggcatccccacacaagtcttcaagggtgtgagtgtgacttacttaggctcagatatggaggtgtctggcttgactgacctgtgtgagatagaagagctcaagtccaagaagctggcattggctccctgcaatcaggctggcatgggggtagtaggcaaggttggagagatacagtgtagtagcgaggaaagtgcccgtaccataaagaaagatgggtgtatatggaatgctgaccttgtgggcatagagctacgagtggatgacgctgtgtgctactctaagatcactagtgtggaggcagttgcaaactactctgccatacccaccactattggagggctaaggtttgagagaagccatgacagccagggtaaaatatctggtagccccctagacatcacagccgtaagagggtctttttctgttaattatagaggccttcgattgagcctctcagaaattactgctacttgcacaggagaggtgacgaatgtgagtgggtgttactcttgcatgacaggcgccaaagtctccatcaaactgcatagcagcaaaaatagcactgcccatgtaagatgcaaaggggatgagactgcgttcagtgtcctggaaggagttcatagctatactgtcagtctcagctttgaccatgcagtggtcgatgagcagtgccagctgaactgtggggggcatgagagtcaagtgactctaaaaggcaacctcatcttcctggatgtcccaaaatttgtagatggcagctatatgcagacatatcacagttctgtgcccacaggggctaatatcccaagccctacagactggctgaatgccttgtttggcaatgggctgagtaggtggattctgggggtgataggggttctactgggggtattggctctcttcttcttaatcatgtctttgttcaaactgggaacaaaacaagtatttcgatcaaggacgaagctggcttag

SEQ ID NO: 4714 - RNA, 3222 nt, synthetic construct
  misc_feature 1..3222: note = derived and/or modified CDS sequence (wt) from SFTSV(JS2012-020)__KC505142.1__GP
  source 1..3222: mol_type = other RNA
atgatgaaagtcatctggttctcctctctgatctgcttagtcattcaatgtggtggggatacaggcccaatcatctgcgcaggacccatccactcaaacaagagtgctgacatacctcacctgcttggctactctgagaagatttgtcagatagatcggctgatacatgtttcgtcatggcttagaaaccactcacaatttcagggctacgtagggcagcgaggtggacgctctcaggtgagctactacccagctgaaaattcttactcaaggtggagtggacttctaagcccctgtgatgctgattggcttgggatgcttgtcgtgaagaaggccaaggggtctgatatgatagttcctgggccttcatacaaggggaaagtcttctttgaacggccaacttttgatggatacgttggctggggctgtggtagtgggaagtctaggactgagtcaggtgagctctgcagttcagactctgggactagttctggtcttctgccctcggatagggttctctggataggtgatgttgcttgtcagcctatgacacccatccctgaggagacatttctggagctgaagagctttagccaaagtgaattcccagacatatgcaagattgatggcattgtgttcaaccagtgtgggggtgagagtctacctcagccctttgatgttgcatggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagcccggggaagtcgttgtgtcatatggagggatgcgtgtcggaccaaagtgctatggtttctccagaatgatggcaacactggaggtgaaccaaccagagcaaaggattggtcaatgcactggctgccatctagaatgcataaatgggggtgtgaggctaatcactctaaccagtgagctcaagtcagctactgtctgcgcttctcacttttgtagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattatcatcctccttggatatgcaggcctcatgctactcaccaatgttcttaaggcaattggggtttggggatcatgggtcatagctccagtgaagctagtgtttgccatcataaagaaactaatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaaggaagcggaaatatgaaggaatgtgtcacaactgggagggcgcttcttcctgcggtgaacccagggcaagaggcgtgtctgcacttcacggcacctggaagtccagactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagcggctgctctgatggatgtggaggagcagcctgcggttgctttaatgcggccccttcatgcattttctggaggaaatgggtagagaatccacatgggatcatctggaaagtctctccatgtgccgcatgggtcccatcagcagttatagagctaacaatgccctcaggggaggtgaggacattccaccccatgagcggaatccccacacaagtcttcaagggtgtgagtgtatcttacttgggctcagatatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgaccttgtgggcatagagctacgagtggatgacgctgtgtgttactctaagatcactagtgtggaggcagttgcaaactactctgctatacccaccactattggggggctgaggtttgagagaagccatgacagccagggtaaaatatctggtagccccctggacatcacagctataagaggatctttttctgtcaattatagaggccttcgactgagtctctcagaaattactgctacgtgtacaggggaagtgacaaatgtgagtgggtgttattcatgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtggggggcatgagagtcatgtaactctgaaaggtaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggtgtgataggggtcctactggggggattggctctctttttcttgatcatgtctttgttcaagctgggaacaaaacaggtatttcgatcgaggacgaagctggcttag

SEQ ID NO: 4715 - RNA, 3222 nt, synthetic construct
  misc_feature 1..3222: note = derived and/or modified CDS sequence (wt) from SFTSV(JS2012-035)__KC505145.1__GP
  source 1..3222: mol_type = other RNA
atgatgaaagtcatctggttctcctctctgatctgcttagtcattcaatgtggtggggatacaggcccaatcatctgcgcaggacccatccactcaaacaagagtgctgacatacctcacctgcttggctactctgagaagatttgtcagatagatcggctgatacatgtttcgtcatggcttagaaaccactcacaatttcagggctacgtagggcagcgaggtggacgctctcaggtgagctactacccagctgaaaattcttactcaaggtggagtggacttctaagcccctgtgatgctgattggcttgggatgcttgtcgtgaagaaggccaaggggtctgatatgatagttcctgggccttcatacaaggggaaagtcttctttgaacggccaacttttgatggatacgttggctggggctgtggtagtgggaagtctaggactgagtcaggtgagctctgcagttcagactctgggactagttctggtcttctgccctcggatagggttctctggataggtgatgttgcttgtcagcctatgacacccatccctgaggagacatttctggagctgaagagctttagccaaagtgaattcccagacatatgcaagattgatggcattgtgttcaaccagtgtgagggtgagagtctacctcagccctttgatgttgcatggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagcccggggaagtcgttgtgtcatatggagggatgcgtgtcagaccaaagtgctatggtttctccagaatgatggcaacactgggggtgaaccaaccagagcaaaggattggtcaatgcactggctgccatctagaatgcataaatgggggtgtgaggctaatcactctaaccagtgagctcaagtcagctactgtctgcgcttctcacttttgtagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccacagtgctaccctgcaaagaagtggctgttcatcattattgtcatcctccttggatatgcaggcctcatgctactcaccaatgttcttaaggcaattggggtttggggatcatgggtcatagctccagtgaagctagtgtttgccatcataaagaaactaatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaaggaagcggaaatatgaaggaatgtgtcacaactgggagggcgcttcttcctgcggtgaacccagggcaagaggcgtgcctgcacttcacggcacctggaagtccagactcaaaatgtctcaaaattaaggttaagaggatcaacctaaaatgtaaaaagtcatcatcgtattttgttcctgatgcccggtccaggtgtacatcagtgaggagatgtcgttgggcaggggactgccagtctgggtgcccccctcatttcacatccaactccttttctgatgattgggcaggtaagatggacagggctggtctgggattcagcggctgctctgatggatgtggaggagcagcctgcggttgctttaatgcggccccttcatgcattttctggaggaaatgggtagagaatccacatgggatcatctggaaagtctctccatgtgccgcatgggtcccatcagcagttatagagctaacaatgccttcaggggaggtgaggacattccaccccatgagcggaatccccacacaagtcttcaagggtgtgagtgtaacttacttgggctcagatatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgcaccataaaaaaagatgggtgcatatggaatgcagacctcgtgggtatagagctacgagtggatgacgctgtgtgttactccaagatcactagtgtggaggcagttgcaaactactctgccatacccaccactattggggggctgaggtttgagagaagccatgacagccagggtaaaatatctggtagccccctggacatcacagctataagaggatctttttctgtcaattatagaggccttcgactgagtctctcagaaattactgctacgtgtacaggggaagtgacaaatgtgagtgggtgttattcatgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtggggggcatgagagtcatgtgactctgagaggtaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtctttgttcaagctgggaacaaaacaggtatttcgatcgaggacgaagctggcttag

SEQ ID NO: 4716 - RNA, 3222 nt, synthetic construct
  misc_feature 1..3222: note = derived and/or modified CDS sequence (wt) from SFTSV(JS2012-79)__KR230772.1__GP
  source 1..3222: mol_type = other RNA
atgatgaaagtcatctggttctcctctctgacctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggttagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggtagtgggaagtctaggacagagtcaggggagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggagaagaggcatctgaagccaagtgtagatgctcacttgtacacaagcccggagaagtcgttgtgtcatatggagggatgcgtatcagaccaaagtgctatggtttctccagaatgatggcaacactggaggtgaaccaaccagagcaaaggcttggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatgtttgccatcataaagaagctaatgagaactgtgagctgcttgatgaggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgcgatgagatggtccatgctgattctaagcttgtttcatgcaggcaagggagcggaaatatgaaggaatgtgtcacaactgggagggcgcttctttctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggtttagtggctgctctgatggatgtggaggagcagcctgcggctgctttaatgcagccccttcatgcatcttctggaggaaatgggtagagaacccacatggaatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaaactggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgttactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagactgcattcagtgtcttggagggaggtcatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagcaggtggatcctgggggtgataggggttctgcttggggggttggctctctttttcatgattatgtctttgttcaagctgggaacaaaacaggtatttcgatcaaggacaaagctggcttag

SEQ ID NO: 4717 - RNA, 3222 nt, synthetic construct
  misc_feature 1..3222: note = derived and/or modified CDS sequence (wt) from SFTSV(JS2013-44)__KR230773.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagctttagccaaagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggggaagagacatctgaagccaagtgtagatgctcacttgtacacaagcccggagaagtcgttgtgtcatatggagggatgcgtatcagaccaaagtgctatggtttctccagaatgatggcaacactggaggtgaaccaaccagagcaaaggcttggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcactaatgtcctcaaggcaattgggatttggggatcatgggtcatagctccagtgaagctaatgtttgccatcataaagaagctaatgagaactgtgagctgcttgatgaggaaattgatggatagggggaggcaagtgatccatgaggagataggggagaatagagagggcaaccaagatgatgttaggattgagatggcaagacccagaagggtaaggcattggatgtactcacctgtcatcctaactattttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgcctcaaaattaaggttaagaggatcaacctaaaatgtaaaaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgctactctaagatcactagtgtggaagcagttgcaaactactctgccatacccaccactattggggggctgaggtttgagagaagccatgacagccagggtaaaatatctggtagccccctagacatctcagctataagaggatctttctctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagactgcattcagtgtcttggagggggtccatagctacattgtcagtctcagttttgaccatgcagtagtcgatgagcagtgccaactgaactgtggggggcatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagcaggtggatcctgggggtgataggggttctgcttggggggttggctctcttttccatgattatgtctttgttcaagctgggaacaaaacaggtatttcgatcaaggacaaagctggcttag

SEQ ID NO: 4718 - RNA, 3222 nt, synthetic construct
  misc_feature 1..3222: note = derived and/or modified CDS sequence (wt) from SFTSV(JS2013-46)__KR230774.1__GP
  source 1..3222: mol_type = other RNA
atgatgaaagtcatctggttctcctctctgatctgcttagtcattcaatgcggtggggatacaggcccaatcatctgcgcaggacccatccactcaaacaagagtgctgacataccccacctgcttggctactctgagaagatttgtcagatagatcggctgatacatgtttcgtcatggcttagaaaccactcacaatttcagggctacgtagggcagcgaggtggacgatctcaggtgagctactacccagctgaaaattcttactcaaggtggagtggacttctaagcccctgtgatgctgattggcttgggatgcttgtcgtgaagaaggccaaggggtctgatatgatagttccagggccttcatacaaggggaaagtcttttttgaacggccaacttttgatggatacgtaggctggggctgtggtagcgggaagtctaggactgagtcaggtgagctctgcagttcagactccgggactagttctggtcttctgccctcagatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtacaagagagctcatccaaggattttgtgtgctacaaggaagggactggaccttgttctgaatcagaagaaaagacttgcaagaccagtggatcatgcaggggggacatgcagttttgcaaggtggcaggttgtgaacatggggaagaggcatctgaagccaagtgcagatgctcacttgtgcacaagcccggggaagtcgttgtgtcatatggagggatgcgtgtcagaccaaagtgctacggtttctccagaatgatggcaacactggaggtgaacgaaccagagcagaggattggtcaatgcactggctgccatctagaatgcataagtgggggtgtgaggctaatcactctaaccagtgagctcaagtcagctactgtctgcgcttctcacttctgtagttctgccacaagtggtaagaaaagcacggagattcaattccactcaggatcattggttgggaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctactcaccaatgttcttaaggcaattggggtttgggggtcatgggtcatagctccagtgaagctagtgtttgccatcataaagaaactaatgagagctgtgagctgcctgatggggaaattgatggatagaggaaggcaagtgatccatgaggaaataggggagaatagagagggcaaccaagatgatgttaggattgagatggccagacccaggagggtaaggcattggatgtactcgcctgtcatcctgactattctagcaatggggcttgctgagggctgtgatgagatggtccatgctgattctaaacttgtttcgtgcaggcaagggagcggaaatatgaaggaatgtgtcacaactgggagggcgcttcttcctgcagtgaacccagggcaagaggcgtgtctgcacttcatggcacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgtggttgctttaatgcggccccttcttgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggtatagagctacgggtggatgacgctgtgtgctactctaagatcactagtgtggaggcagttgcaaactactccgccatacccaccactattggggggctgaggtttgagagaagccatgacagccagggcaaaatatctggtagccccctggacatcacagctataagaggatctttttctatcaattatagaggccttcgactgagcctctcagaaatttctgctacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagcactgtgcccacaggggcaaatatcccaagccccacagattggctaaatgccttgtttggcaatgggctgagtaggtggatcctgggggtgataggggtcctactggggggattggctctctttttcttgatcatgtctttgttcaagctgggaacaaaacaggtatttcgatcgaggacgaagctggcttaa

SEQ ID NO: 4719 - RNA, 3222 nt, synthetic construct
  misc_feature 1..3222: note = derived and/or modified CDS sequence (wt) from SFTSV(JS2013-52)__KR230775.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggcagtgggaagtctaggacagagtcgggagagctctgcagttcagactcagggactagctctggtcttctgccctcagatagggttctctggataggtgatgtggcttgtcagcccatgacacccatccctgaggagacatttttggagctgaagagttttagccagagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtacacaagcccggagaagtcgttgtgtcatatggagggatgcgtgtcagaccaaagtgctatggtttctccagaatgatggcaacactggaggtgaaccaaccagagcaaaggattggccaatgcactggctgccatctggaatgcataaatgggggtgtgaggctaataaccctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctaacttttttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcgcctgggagtccggactcaaaatgtctcaaaattaaggttaagaggatcaacctaaaatgtaagaagtcatcatcatattttgttcctgatgcccggtccaggtgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaagaaagatgggtgcatatggaatgcagaccttgtgggcatagagctacgagtagatgacgccgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgtcaattatagaggccttcgactgagcctctcagaaattactgctacctgcacaggagaggtgacaaatgtgagtggatgttattcttgcatgacaggcgccaaagtctctatcaaactgcacagcagcaaaaatagcactgcccatgtaagatgcaaaggggatgagactgccttcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggtagctacatgcagacatatcatagcactgtgcccacaggggcaaatatcccaagcccaacagactggctgaatgccttgtttggcaatgggctgagcaggtggatcctgggggtgataggggttctgctgggggtattggctctcttcttcttaatcatgtctttgttcaaactgggaacaaaacaagtatttcgatcaaggacgaagctggcttag

SEQ ID NO: 4720 - RNA, 3222 nt, synthetic construct
  misc_feature 1..3222: note = derived and/or modified CDS sequence (wt) from SFTSV(JS2013-69)__KR230776.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctaagaaaccactcacaatttcagggctacgtagggcagcgaggtggacgctctcaggtgagctactacccagctgaaaactcttactcaaggtggagtggacttctaagcccctgtgatgctgattggcttgggatgcttgtcgtgaagaaggccaaggggtctgatattatagttcctgggccttcatacaaggggaaagtcttttttgagcggccaacttttgatggatatgtaggctggggctgtggtagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccaatgtgagggtgagagtctacctcagccttttgatgttgcatggatggatgttggccactctcataaaatcatcatgagggagcacaagaccaaatgggtacaagagagctcatcaaaagattttgtgtgctataaggaagggactgggccttgttctgaatcagaagaaaagacttgcaagaccagtggatcatgcaggggggacatgcagttctgcaaggtagcaggttgtgaacatggagaagaggcatctgaagccaagtgtagatgctcacttgtacacaagcccggagaagtcgttgtgtcatatggagggatgcgtgtcagaccaaagtgctatggtttctccagaatgatggcaacactggaggtgaaccaaccagagcaaaggcttggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacattggagagtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactgtgagctgcttgatgaggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccaggtgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcggccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaagagctcaagtccaagaagctggcattggctccctgcaatcaggctggcatgggggtagtaggcaaggttggagagatacagtgcagtagcgaggaaagtgcccgtaccataaagaaagatgggtgtatatggaatgctgaccttgtgggcatagagctacgagtggatgacgctgtgtgctactctaagatcactagtgtggaggcagttgcaaactactctgccatacccaccactattggagggctaaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtgggtgttactcttgcatgacaggcgccaaagtctccatcaaactgcatagcagcaaaaatagcactgcccatgtaagatgcaaaggggatgagactgcgttcagtgtcctggaaggagttcatagctatactgtcagtctcagctttgaccatgcagtggtcgatgagcagtgccagctgaactgtggggggcatgagagtcaagtgactctaaaaggcaacctcatcttcctggatgtcccaaaatttgtagatggcagctatatgcagacatatcacagttctgtgcccacaggggctaatatcccaagccctacagactggctgaatgccttgtttggcaatgggctgagtaggtggattctgggggtgataggggttctactgggggtattggctctcttcttcttaatcatgtctttgttcaaactgggaacaaaacaagtatttcgatcaaggacgaagctggcttag

SEQ ID NO: 4721 - RNA, 3222 nt, synthetic construct
  misc_feature 1..3222: note = derived and/or modified CDS sequence (wt) from SFTSV(JS2013-71)__KR230777.1__GP
  source 1..3222: mol_type = other RNA
atgatgaaagtcatctggttctcctctctgatctgctttgtcattcaatgtggtggggatacaggcccaatcatctgcgcaggacccatccactcaaataagagtgctgacatacctcacctgcttggctactctgagaagatttgtcagatagatcggctgatacatgtttcgtcatggcttagaaaccactcacaatttcagggctacgtagggcagcgaggtggacgctctcaggtgagctactacccagctgaaaattcttactcaaggtggagtggacttctaagcccctgtgatgctgattggcttgggatgcttgttgtgaagaaggccaaggggtctgatatgatagttcctgggccttcatacaaggggaaagtcttctttgaacggccaacttttgatggatacgttggctggggctgtggtagtgggaagtctaggactgagtcaggtgagctctgcagttcagactctgggactagttctggtcttctgccctcggatagggttctctggataggtgatgttgcttgtcagcctatgacacccatccctgaggagacatttctggagctgaagagctttagccaaagtgaattcccagacatatgcaagattgatggcattgtgttcaaccagtgtgagggtgagagtctacctcagccctttgatgttgcatggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcataagcccggggaagtcgttgtgtcatatggagggatgcgtgtcagaccaaagtgctatggtttctccagaatgatggcaacactggaggtgaaccaaccagagcaaaggattggtcaatgcactggctgccatctagaatgcataaatgggggtgtgaggctaatcactctaaccagtgagctcaagtcagctactgtctgcgcttctcacttttgtagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctactcaccaatgttcttaaggcaattggggtttggggatcatgggtcatagctccagtgaagctagtgtttgccatcataaagaaactaatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcacctgtcatcctgactattctagcaatagggcttgctgagggctgtgatgagatggtccatgctgattctaaacttgtttcgtgcaggcaaggaagcggaaatatgaaggaatgtgtcacaactgggagggcgcttcttcctgcggtgaacccagggcaagaggcgtgtctgcacttcacggcacctggaagtccagactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagcggctgctctgatggatgtggaggagcagcctgcggttgctttaatgcggccccttcatgcattttctggaggaaatgggtagagaatccacatgggatcatctggaaagtctctccatgtgccgcatgggtcccatcagcagttatagagctaacaatgccctcaggggaggtgaggacattccaccccatgagcggaatccccacacaagtcttcaagggtgtgagtgtaacttacttgggctcagatatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggcatagagctacgagtggatgacgctgtgtgttactctaagatcactagtgtggaggcagttgcaaactactctgccatacccaccactattggggggctgaggtttgagagaagccatgacagccagggtaaaatatctggtagccccctggacatcacagctataagaggatctttttctgtcaattatagaggccttcgactgagtctctcagaaattactgctacgtgtacaggggaagtgacaaatgtgagtgggtgttattcatgcatgacaggcgccaaagtctccatcaagttgcatagcagcaaaaatagcactgcccatgtgagatgcaaaggggatgagactgccttcagtgtcttggagggagtccatagctactctgtcagtctcagttttgatcatgcagtagttgatgagcagtgccaactgaactgtggggggcatgagagtcatgtgactctgagaggtaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtctttgttcaagctgggaacaaaacaggtatttcgatcgaggacgaagctggcttag

SEQ ID NO: 4722 - RNA, 3222 nt, synthetic construct
  misc_feature 1..3222: note = derived and/or modified CDS sequence (wt) from SFTSV(JS2014-03)__KR230778.1__GP
  source 1..3222: mol_type = other RNA
atgatgaaagtcatctggttctcctctctgatctactttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtacacaagcccggagaagtcgttgtgtcatatggagggatgcgtatcagaccaaagtgctatggtttctccagaatgatggcaacactggaggtgaaccaaccagagcaaaggattggccaatgcactggctgccatctggaatgcataaatgggggtgtgaggctaataaccctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaacgtcctcaaggcaattgggatttggggatcatgggtcatagctccagtgaagctaatgtttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctaacttttttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcgcctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtgggcagggttggagagatacagtgcagtagcgaggaaagtgcccgtaccataaaaaaagatgggtgcatatggaatgcagaccttgtgggcatagagctacgagtagatgacgctgtgtgctactctaagatcactagtgtggaagcagttgcaaactactctgctatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagacagcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggtagctacatgcagacatatcatagcactgtgcccacaggggcaaatatcccaagcccaacagactggctgaatgccttgtttggcaatgggctgagcaggtggatcctgggggtgataggggttctgcttggggggttggctctctttttcatgattatgtctttgttcaagctgggaacaaaacaggtatttcgatcaaggacaaagctggcttag

SEQ ID NO: 4723 - RNA, 3222 nt, synthetic construct
  misc_feature 1..3222: note = derived and/or modified CDS sequence (wt) from SFTSV(JS2014-16)__KR230780.1__GP
  source 1..3222: mol_type = other RNA
atgatgaaagtcatctggttctcctctctgatctgcttagtcattcaatgcagtggggatacaggcccaatcatatgcgcagggcccatccactcgaacaagagtgccaacataccccacctgcttggttactctgagaagatttgtcagatagatcggctgatacatgtttcgtcatggctgagaaaccattcacaatttcagggctacgtggggcagcgaggtggtcgctctcaggtgagttactacccagctgaaaactcttactcaaggtggagtggacttctaagcccctgtgatgctgattggcttgggatgcttgtcgtgaagaaggccaaggggtctgatatgatagttcctgggccttcatacaaggggaaggtcttttttgaacggccaacttttgatggatacgtgggctggggctgtggcagtgggaagtcaaggactgagtcaggtgaactctgcagctcagactcagggaccagttctggtcttctgccgtcagatagggttctctggataggtgatgtggcttgtcagcccatgacacccatccctgaggagacatttttggagctgaagagttttagccagagtgaattcccagacatatgcaaagttgatggcattgtattcaaccagtgtgatagtgagagtctacctcagcccattgatgtcgcatggatggatgtaggtcactctcataagatcatcatgagggagcacaagaccaaatgggtacaagagagctcatcaaaagattttgtgtgctacaaggaaggaactgggccatgttctgaatcggaagaaaagacttgtaagaccagtggatcatgcaggggggacatgcagttttgcaaggtggcaggttgtgaacatggggaagaggcatctgaagccaagtgtagatgctcactagtgcataagcccggggaagttgttgtgtcatatggagggatgcgtgtcagaccaaagtgttatggtttttccagaatgatggcaacactagaggtgaaccctcctgagcaaagaattggccaatgcactggctgccatctagaatgcataaatgggggtgtgaggctaatcactctaactagcgagctcaagtcagctactgtctgtgcttcccacttttgtagttctgccacaagtggcaagaaaagcacggagattcaattccactcagggtcattggttgggaaagcagcaatacacgtcaaaggggctttggtggatggaactgaattcacgtttgagggcagttgcatgttcccagatggttgtgacgcagtggactgcacattctgtcgtgagtttctaaaaaatccgcagtgctaccctgcaaagaaatggttgttcattattattgtcatcctccttggatatgcaggcctcatgctactcaccaatgtccttaaggcaatcggggtttggggatcatgggtcatggctccagtgaagctaatgtttgccatcataaagaaactgatgagatctgtgagctgcatgatgggaaaattgatggataggggaaggcaagtgatccatgaagaaataggggagaatagagagggcaaccaagatgatgttaggatcgagatggcaagacccagaagggtgaggcattggatgtactcacctgtcatcctgactattctagcaattgggcttgctgagggctgcgatgagatggtccatgcagattctaaacttgttttgtgcagacaagggagcggaaatatgaaggaatgtgtcacaactgggagggcactccttcctgcggttaacccaggacaagaagcatgtctgcacttcacggcacctgggagtccggactcaaaatgtctcaagatcaaggttaagaggatcaacctaaaatgtaagaagtcatcatcatattttgttcctgatgctcggtccaggtgtacatctgtgaggagatgtcgctgggcaggagactgtcagtctgggtgcccctctcatttcacgtccaactccttctctgatgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccttcagcagtcatagagctgacaatgccctcgggggaagtgaggacattccaccccatgagcggcatccccacacaagtcttcaagggtgtgagtgtgacttacttaggctcagatatggaggtgtctggcttgactgacctgtgtgagatagaagagctcaagtccaagaagctggcattggctccctgcaatcaggctggcatgggggtagtaggcaaggttggagagatacagtgtagcagcgaggaaagtgcccgtaccataaagaaagatgggtgtatatggaatgctgaccttgtgggcatagagctacgagtggatgacgctgtgtgctactctaagatcactagtgtggaggcagttgcaaactactctgccatacccaccactattggagggctaaggtttgagagaagccatgacagccagggtaaaatatctggtagccccctagacatcacagccataagagggtccttttcggttaattatagaggccttcgactgagcctctcagaaattactgctacttgcacaggagaggtgacgaatgtgagtgggtgttactcttgcatgacaggcgccaaagtctccatcaaactgcatagcagcaaaaatagcactgcccatgtaagatgcagaggggatgagactgcgttcagtgtcctggaaggagttcatagttacactgtcagtctcagctttgaccatgcagtggtcgatgagcagtgccagctgaactgtggggggcatgagagtcaagtgactctaaaaggcaacctcatcttcctggatgtcccaaaatttgtagatggcagctatatgcagacatatcatagttctgtgcccacaggggctaatatcccaagccctacagactggctgaatgccttgtttggcaatgggctgagtaggtggattctgggggtgataggggttctactgggggtattggctctcttcttcttaatcatgtctttgttcaaactgggaacaaaacaggtatttcgatcaaggacgaagctggcttag

SEQ ID NO: 4724 - RNA, 3222 nt, synthetic construct
  misc_feature 1..3222: note = derived and/or modified CDS sequence (wt) from SFTSV(JS2014-18)__KR230781.1__GP
  source 1..3222: mol_type = other RNA
atgatgaaagtcatctggttctcctctctgatctgcttagtcattcaatgcggtggggatacgggcccaatcatctgtgcaggacccatccactcaaacaagagtgctgacataccccacctgcttggctactctgagaagatttgtcagatagatcggctgatacatgtttcgtcatggctcagaaaccactcacaatttcagggctacgtagggcagcgaggtggacgctctcaggtgagctactacccagctgaaaattcttactcaaggtggagtggacttctaagcccctgtgatgctgattggcttgggatgcttgtcgtgaagaaggccaaggggtctgatatgatagttcctgggccctcatacaagggaaaagtcttttttgaacggccaacttttgatggatacgtaggctggggctgtggtagtgggaagtctaggactgagtcaggtgagctctgcagttcagactccgggactagctctggtcttctgccctcggatagggttctctggataggtgatgttgcttgtcagcctacgacacccatccctgaggagacatttctggagctgaagagctttagccaaagtgaattcccagatgtatgcaaaattgatggcattgtgttcaaccagtgtgagggtgagagtctacctcagccctttgatgttgcgtggatggatgttggccactctcataaaatcatcatgagggagcacaagaccaaatgggtgcaagagagctcatccaaggattttgtgtgctacaaggaagggactgggccttgttctgaatcagaggaaaagacttgcaagaccagtggatcatgcaggggggacatgcagttttgcaaggtggcaggttgtgaacatggggaagaggcatctgaagccaagtgtagatgttcacttgtgcacaagcccggggaagtcgttgtgtcatatggagggatgcgtgtcagaccaaagtgctatggtttctccagaatgatggcaacactggaggtgaacccaccagagcaaaggattggtcaatgcactggctgccatctagaatgcataaatgggggtgtgaggctaatcactctaaccagtgagctcaagtcagctactgtctgcgcttctcacttttgtagttctgccacaagtggtaagaaaagcacggagattcaattccactcaggatcattggttgggaagacagcaatccacgtcaaaggggcattggtagatggaactgaattcacatttgagggtagctgcatgttcccagatggttgtgatgcagtggactgcacattctgtcgtgagtttctaaaaaatcctcagtgctaccctgcaaagaagtggctgttcatcattattgtcatcctcctaggatatgcaggcctcatgctactcaccaatgttcttaaggcaattggggtttgggggtcatgggtcatagccccagtgaagctagtgtttgccatcataaagaaactaatgagagctgtgagctgcctgatggggaaattgatggataggggaaggcaagtgatccatgaggaaataggggagaatagagagggcaaccaagatgatgttaggatcgagatggccagacccaggagggtaaggcattggatgtactcgcctgtcatcctgactattctagcaatagggcttgctgagggctgtgatgagatggtccatgctgattctaaacttgtttcatgcaggcaagggagcggaaatatgaaggaatgtgttacaactgggagggcgcttcttcctgcggtgaaccctgggcaagaggcgtgtctgcacttcacggcacctggaagtccggactcaaaatgtctcaaaattaaggttaagaggatcaacctaaaatgtaagaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatgggtgtggaggagcagcctgcggttgctttaatgcggccccttcatgcattttctggaggaaatgggtagagaatccacatgggatcatctggaaagtatctccatgtgccgcatgggtcccatcagcagttatagagctaacaatgccctcaggggaggtgaggacattccaccccatgagcggaatccccacacaagtcttcaagggtgtgagtgtaacttacttgggctcagacatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaagaaagatgggtgcatatggaatgctgacctcgtgggtatagagctgcgagtggatgacgctgtgtgctactctaagatcactagtgtggaggcagttgcaaactactccgccatacccaccactattggggggctgaggtttgagagaagccatgacagccagggtaaaatatctggaagccccctggacatcacagctataagaggatccttttctgttaattatagaggccttcgactgagtctctcagaaattactgctacttgcacaggggaagtgacaaatgtgagtgggtgttattcctgcatgacaggcgccaaagtctccatcaaattgcatagcagcaaaaatagcactgctcatgtgagatgcaaaggggatgagactgcattcagtgtcttggagggagtccatagctactctgtcagtctaagttttgatcatgcagtagtcgatgagcagtgccaactgaactgtgggggacatgagagtcaagtgactctaagaggcaacctcatcttcctggatgtcccgaaatttgtggatggcagctacatgcagacatatcatagtactgtgcccacaggggcaaatatcccaagccctacagattggctgaatgccttgtttggcaatgggctgagtaggtggattctgggggtgataggggtcctactggggggattggctctctttttcttgatcatgtctttgttcaagctgggaacaaaacaggtatttcgatcgaggacgaaactggcttag

SEQ ID NO: 4725 - RNA, 3222 nt, synthetic construct
  misc_feature 1..3222: note = derived and/or modified CDS sequence (wt) from SFTSV(JS2014-31)__KR230782.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggtagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggagaagaggcatctgaagccaagtgtagatgctcacttgtacacaagcccggagaagtcgttgtgtcatatggagggatgcgtatcagaccaaagtgctatggtttctccagaatgatggcaacactggaggtgaaccaaccagagcaaaggcttggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggcagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactgtgagctgcttgatgaggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatggaatcatctggaaagtatctccttgtgccgcatgggtcccatcggcagtcatagagctaacaatgccctcaggggaggtgaggacattccaccccatgagtggaatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgttactctaagatcactagtgtggaagcagttgcaaactactctgccatacccaccactattggggggctgaggttcgagagaagccatgacagccagggtaaaatatctggtagccccctggacatcacagctataagagggtctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagactgccttcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagcaggtggatcctgggggtgataggggttctgctgggggtattggctctcttcttcttaatcatgtctttgttcaaactgggaacaaaacaggtatttcgatcaaggacgaagctggcttag

SEQ ID NO: 4726 - RNA, 3222 nt, synthetic construct
  misc_feature 1..3222: note = derived and/or modified CDS sequence (wt) from SFTSV(JS2014-33)__KR230783.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacataccccacctgctgggttactctgagaagatatgtcagatagatcggctgatacatgtttcgtcatggctcagaaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaaaaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagctttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcactagtgcacaagcccggagaagtcgttgtgtcatatggagggatgcgtgtcagaccaaagtgctatggtttctccagaatgatggcaacactggaggtgaaccagccagagcaaaggattggtcaatgcactggctgccatctggaatgcataaatgggggtgtgaggctaataactctaaccagtgagctcaagtcagctactgtctgtgcctcccacttttgtagttctgccacgagtggcaagaaaagcacggagattcaattccactcgggatcattggttgggaaaacagcaatacacgtcaaaggggcattggtagatggaactgaattcacatttgagggtaattgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagagctgtgggctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggggcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatccgtgaggagatgtcgttgggctggagactgccagtctgggtgcccccctcatttcacatccaactccttttccgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcctgcatgacaggcgccaaagtctctatcaaactacatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctatatgcagacatatcatagcgctgtgcccacaggggcaaatatcccaagtccaacagactggctgaatgccttgtttggcaatgggctgagtaggtggatcctgggggtgataggggttctgcttggggggttggctctctttttcatgattatgtctttgttcaagctgggaacaaaacaggcatttcgatcaaggacgaagctggcttag

SEQ ID NO: 4727 - RNA, 3222 nt, synthetic construct
  misc_feature 1..3222: note = derived and/or modified CDS sequence (wt) from SFTSV(JS2014-39)__KR230784.1__GP
  source 1..3222: mol_type = other RNA
atgatgaaagtcatctggttctcctctctgacctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggttagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtgggagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggggaagagacatctgaagccaagtgtagatgctcacttgtacacaagcccggagaagtcgttgtgtcatatggagggatgcgtatcagaccaaagtgctatggtttctccagaatgatggcaacactggaggtgaaccaaccagagcaaaggcttggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcactaatgtcctcaaggcaattgggatttggggatcatgggtcatagctccagtgaagctaatgtttgccatcataaagaagctaatgagaactgtgagctgcttgatgaggaaattgatggatagggggaggcaagtgatccatgaggagataggggagaatagagagggcaaccaagatgatgttaggattgagatggcaagacccagaagggtaaggcattggatgtactcacctgtcatcctaactattttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgcctcaaaattaaggttaagaggatcaacctaaaatgtaaaaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgctactctaagatcactagtgtggaagcagttgcaaactactctgccatacccaccactattggggggctgaggtttgagagaagccatgacagccagggtaaaatatctggtagccccctagacatctcagctataagaggatctttctctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagactgcattcagtgtcttggagggggtccatagctacattgtcagtctcagttttgaccatgcagtagtcgatgagcagtgccaactgaactgtggggggcatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagcaggtggatcctgggggtgataggggttctgcttggggggttggctctcttttccatgattatgtctttgttcaagctgggaacaaaacaggtatttcgatcaaggacaaagctggcttag

SEQ ID NO: 4728 - RNA, 3222 nt, synthetic construct
  misc_feature 1..3222: note = derived and/or modified CDS sequence (wt) from SFTSV(JS2014-H.longicornis-02)__KR230786.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggtagtgggaagtctaggacagagtcaggagagctctgcagttcagactcagggactagctctggtcttctgccctcagatagggttctctggataggtgatgttgcttgtcagcctatgacacccatccctgtagaggcatttctggagctgaagagttttagccaaagtgaattcccagacatatgcaaaattgatggcattgtgttcaaccagtgtgagggtgagagtttacctcagccttttgatgttgcatggatggatgttggccactctcataaaatcatcatgagggagcacaagaccaaatgggtgcaagagagctcatccaaggattttgtgtgctataaggaagggactgggccttgtcctgaatcagaagaaaagacttgcaagaccagtggatcatgcaggggggacatgcagttctgcaaggtagcaggttgtgaacatggagaagaggcatctgaagccaagtgtagatgctcacttgtacacaagcccggagaagtcgttgtgtcatatggagggatgcgtatcagaccaaagtgctatggtttctccagaatgatggcaacactggaggtgaaccaaccagagcaaaggcttggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactgtgagctgcttgatgaggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatggaatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgttactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagactgccttcagtgtcttggagggggtccatagctacactgtcagtctcagttttgaccatgcagtagtcgatgagcagtgccaactgaactgtgggggacatgagagtcaagtaactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagcaggtggatcctgggggtgataggggttctgcttggggggttggctctctttttcatgattatgtctttgttcaagctgggaacaaaacaggtatttcgatcaaggacaaagctggcttag

SEQ ID NO: 4729 - RNA, 3222 nt, synthetic construct
  misc_feature 1..3222: note = derived and/or modified CDS sequence (wt) from SFTSV(JS2014-H.longicornis-03)__KR230787.1__GP
  source 1..3222: mol_type = other RNA
atgatgaaagtcatctggttctcctctctgacctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggttagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggtagtgggaagtctaggacagagtcaggggagctctgcagttcagactcagggactagctctggtcttctgccctcagatagggttctctggataggtgatgttgcttgtcagcctatgacacccatccctgaagagacatttctggagctgaagagctttagccaaagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtacacaagcccggagaagtcgttgtgtcatatggagggatgcgtatcagaccaaagtgctatggtttctccagaatgatggcaacactggaggtgaaccaaccagagcaaaggattggccaatgcactggctgccatctggaatgcataaatgggggtgtgaggctaataaccctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcagtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactgtgagctgcttgatggggaaattgatggataggggaaggcaagtgatccatgaggagataggggagaatagagagggtaaccaagatgatgttaggattgagatggcaagacccagaagggtaaggcattggatgtactcacctgtcatcctaacttttttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcgcctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggctttagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagacagcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggtagctacatgcagacatatcatagcactgtgcccacaggagcaaatatcccaagcccaacagactggctgaatgccttgtttggcaatgggctgagcaggtggatcctgggggtgataggggttctgcttggggggttggctctcttttttatgattatgtctttgttcaagctgggaacaaaacaggtatttcgatcaaggacaaagctggcttag

SEQ ID NO: 4730 - RNA, 3222 nt, synthetic construct
  misc_feature 1..3222: note = derived and/or modified CDS sequence (wt) from SFTSV(JS2014-Hedgehog-02)__KR230789.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggctcgggatgcttgttgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgtagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaaggaactgggccttgttctgaatcagaagaaaagacttgcaagaccagtggatcatgcaggggggacatgcagttctgcaaggtggcaggttgtgaacatggggaagaggcatctgaagccaagtgtagatgctcacttgtacacaagcccggagaagtcgttgtgtcatatggagggatgcgtatcagaccaaagtgctatggtttctccagaatgatggcaacactggaggtgaaccaaccagagcaaaggattggtcaatgcactggctgccatctggaatgcataaatgggggtgtgaggctaataaccctaaccagtgagctcaagtcagctactgtctgtgcttcccacttttgtagttctgccacgagtggaaagaaaagcacggagattcaattccactcaggatcattggttgggaaaacagcaatacacgtcaaaggggcattggtagatggaactgaattcacatttgagggtagttgcatgttcccagatggttgtgatgcggtggactgcaccttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctaactattttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagtggctgttctgatggatgtggaggagcagcctgcggctgctttaacgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctctgaaattactgctacctgcacaggggaagtgacaaatgtgagtggatgttattcttgcatgacaggcgccaaagtctctatcaaactgcacagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggtagctacatgcagacatatcatagcactgtgcccacaggggcaaatatcccaagcccaacagactggctgaatgccttgtttggcaatgggctgagcaggtggatcctgggggtaataggggttctgcttggggggttggctctctttttcatgattatgtctttgttcaagctgggaacaaaacaggtatttcgatcaaggacaaagctggcttag

SEQ ID NO: 4731 - RNA, 3222 nt, synthetic construct
  misc_feature 1..3222: note = derived and/or modified CDS sequence (wt) from SFTSV(KACNH)__KU507558.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctagcataccccacctgcttggttactccgagaagatttgtcagatagatcggctgatacatgtttcgtcatggctcaggaaccactcgcaatttcaaggctacgtagggcagcgaggtggacgatcccaggtgagctactacccagctgagaattcttactcgaggtggagtggacttctaagcccctgtgatgctgattggcttgggatgcttgtcgtgaagaaggccaaggggtctgacatgatagttcctgggccttcatacaaggggaaagtcttttttgaacgaccaacttttgatggatacgttggctggggctgtggcagtggaaagtctaggactgagtcaggagagctctgcagttcagactcagggactagctctggtcttctgccctcggatagggttctctggataggtgatgttgcttgtcagcctatgacacccatccctgaggagacatttctggagctaaagagttttagccaaagtgaattcccagacatatgcaaaattgatggcattgtgttcaaccagtgtgagggtgagagtctgccccagccctttgatgtagcatggatggatgttggccactctcataaaatcatcatgagggagcacaagaccaaatgggtacaagagagctcatccaaggattttgtgtgctacaaggaagggactgggccttgttctgaatcagaagaaaaggcttgcaagaccagtggatcatgcaggggggacatgcagttttgcaaggtggcaggttgtgaacatggggaggaggcatctgacgccaagtgtagatgctcacttgtgcacaagcccggggaagtcgttgtgtcatatggagggatgcgtgtcagaccaaagtgctatggtttctccagaatgatggcaacactggaggtgaacccaccagagcaaaggattggtcaatgcactggctgccatctagaatgcataaatgggggtgtgaggctaatcactctaaccagtgagctcaagtcagctactgtctgtgcttcccacttttgcagttctgctacaagtggtaagaaaagcacggagattcaattccactcaggatcattggttgggaaaacagcaatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcctcattgtcatcctccttggatatgcaggcctcatgctaatcaccaatgtccttaaggcaattggggtttgggggtcatgggtaatagctccagtgaagctaatgtttgccattataaagaaactaatgagaactgtgagctgcttgatggggaaattgatggataggggaaggcaagtgatccatgaggaaatcggggagaatggggagggcaatcaagatgatgttaggattgagatggcaagacctagaagagtgaggcattggatgtactcacctgtcatcctgaccattctagcaatagggcttgctgagggctgtgatgagatggtccatgctgattctaaactcgtttcatgcaggcaagggagcggaaatatgaaggaatgtgtcacaactgggagggcgcttcttcctgcggtgaacccaggacaagaagcatgtctgcacttcacggcacctggtagtccggactcaaagtgtctcaaaattaaggttaagaggattaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtatctccatgcgccgcatgggtcccatcagcagttatagagctaacaatgccctcaggtgaggtgaggacattccaccccatgagtggcatccccacacaagtcttcaagggtgtgagtgtaacttacttgggctcagatatggaggtgtctggcttgactgacctgtgtgagatagaagagctcaagtccaagaagctagcattagctccctgcaaccaggctggcatgggggttgtaggcaaggttggagagatacagtgcagtagcgaggaaagtgcccgtaccataaaaaaggatgggtgcatatggaatgcagacctggtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacggctataagaggatccttttctgttaactacagaggccttcgattaagtctctcagaaattactgcaacttgcacaggggaggtgacaaatgtgagtgggtgttattcttgcatgacaggcgccaaagtctccatcaaattgcatagcagcaaaaatagcactgcccatgttagatgcaaaggagatgagactgcattcagtgtcttggagggagtccatagctatactgtcagcctcagcttcgaccatgctgtagtcgatgagcagtgccaactgaactgtgggggacatgagagtcaagtgactctaaaaggcaacctcatcttcctggatgtcccaaaatttgtggatggcagctacatgcagacatatcacagtactgtgcccacaggggcaaatatcccaagccccacagattggctgaatgccttgtttggcaatgggctgagtaggtggatcctgggggtgataggggttctactagggggattggctctctttttcttgatcatgtctttgttcaagctgggtacaaaacaggtatttcgatcgaggacgaagctggcttag

SEQ ID NO: 4732 - RNA, 3222 nt, synthetic construct
  misc_feature 1..3222: note = derived and/or modified CDS sequence (wt) from SFTSV(KACNH2)__KU507559.1__GP
  source 1..3222: mol_type = other RNA
atgatgaaagtcatctggttctcctctctgatctgcttagtcattcaatgcagtggggacacgggcccaatcatatgcgcaggacccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtaagttactacccagctgaaaactcttactcaaggtggagtggacttctaagcccctgtgatgctgattggcttgggatgcttgtcgtgaagaaggccaaggggtctgatatgatagtccctgggccttcatacaaggggaaagtcttttttgaacgtccaacttttgatggatacgtgggctggggctgtggcagtgggaagtcaaggacagagtcaggtgagctctgtagctcagactcagggaccagttctggtcttctgccctccaatagggttctctggataggtgatgttgcttgccagcccatgacacccatccctgaggagacatttctagagctgaagagtttcagccagagtgaattcccagacatatgcaaaattgatggcattgtgttcaaccagtgtgagagtgagagcctacctcagccctttgatgtcgcatggatggatgtaggtcactctcataaaatcatcatgagggagcacaagaccaaatgggtacaagagagctcatccaaggattttgtgtgctacaaggaagggactgggccgtgttctgaatcagaagaaaggacttgcaagaccagtggatcatgcaggggggacatgcagttttgcaaggtcgcaggttgtgaacatggggaagaggcatctgaagccaagtgtagatgctccctagtacacaagcccggggaagttgttgtgtcatatggagggatgcgtgtcagaccaaagtgttatggtttctccagaatgatggcaacactagaggtgaaccctccagagcaaagaattggccaatgcactggctgccatatagaatgcataaatgggggtgtgaggctaatcactctaactagtgagctcaagtcagcaactgtctgtgcttcccacttttgtagttctgccacaagtggcaagaaaagcacggagattcaattccactcaggatcattagttgggaaagctgcaatacacgtcaaaggggctttggtggatggaactgaattcacatttgagggcagttgcatgtttccagatggttgtgacgctgtggactgcacattctgtcgtgagttcctaaaaaatcctcagtgctaccctgcaaagaaatggttgttcattattattgtcatcctccttggatatgcaggcctcatgctactcaccaatgtccttaaggcaatcggggtttggggatcatgggtcatagctccagtgaagctaatgtttgccatcataaagaaacttatgagatctgtgagctgcttgatggggaaattgatggataggggaagacaagtgatccatgaagaaataggggagaatagagagggcaaccaagatgatgttaggatcgagatggcaagacccagaagggtgaggcattggatgtactcacctgtcatcctgactattctagcaattgggctcgctgagggctgcgatgagatggtccatgcagattctaaacttgtgtcgtgcaggcaagggggcggaaatatgaaggaatgtgtcacaactggaagggcgctccttcctgcagtgaacccaggacaagaggcatgtctgcacttcacggctcctgggagtccggactcaaaatgtctcaaaatcaaggttaagaggatcaacctaaaatgtaagaagtcatcatcatattttgttcctgatgctcggtccaggtgtacatctgtaaggagatgtcgctgggcaggagactgtcagtctgggtgcccctctcatttcacgtccaactccttctctgatgattgggcaggtaaaatggacagggctggtctaggattcagtgggtgctctgatggatgtggaggagcagcctgcggctgctttaatgcggccccttcatgcatcttttggagaaaatgggtagagaatccacatgggatcatctggaaagtatccccatgtgctgcatgggtcccttcagcagtcatagagctaacaatgccctcgggggaagtgaggacattccaccccatgagcggcatccccactcaagtcttcaagggtgtgagtgtgacttacttaggctcagatatggaggtgtctggcttgaccgacctgtgtgagatagaagaactcaagtccaagaagctggcattagctccctgcaatcaggctggcatgggggtcgtaggcaaggttggagagatacagtgcagtagcgaggaaagcgcccgtaccataaagaaagatgggtgtatatggaatgctgaccttgtgggcatagagctacgagtggatgacgctgtgtgctactctaagatcactagtgtggaggcagttgcaaactactctgccatacccaccactattggggggctgaggtttgagagaagccatgacagccagggtaaaatatctggtagccccctagacatcacagctataagagggtccttttcagtcaattatagaggccttcgactgagcctctcagaaattactgctacttgcacaggtgaggtgacgaatgtgagtgggtgttactcttgcatgacaggcgccaaagtctccatcaaactgcatagcagcaaaaatagcactgcccatgtgagatgcaaaggggatgagaccgcattcagtgtcctggagggaattcatagctatactgtcagtctcagctttgatcatgcagtggtcgatgagcagtgccaactgaactgtggagggcatgagagtcaagtgactctaaagggcaacctcatcttcctggatgtcccaaaatttgtagatggcagctatatgcagacatatcatagttctgtgcccacaggggctaatatcccaagcccaacagactggctgaatgccttgtttggcaatgggctgagtaggtggattctgggggtgataggggttctactggggggattggctctcttcttcttaatcatgtctttgttcaaactggggacaaaacaggtatttcgatcaaggacaaagctggcttag

SEQ ID NO: 4733 - RNA, 3222 nt, synthetic construct
  misc_feature 1..3222: note = derived and/or modified CDS sequence (wt) from SFTSV(KACNH3)__KP663744.1__GP
  source 1..3222: mol_type = other RNA
atgatgaaagtcatctggttctcctctctgatctgcttagtcatccaatgcagtggggatacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtaagctactacccagctgaaaactcttactcaaggtggagtggacttctaagcccctgtgatgctgactggcttgggatgcttgttgtgaagaaagccaaagggtctgatatgatagttcctgggccttcatacaaggggaaagtcttttttgaacggccaacttttgatggatacgtaggctggggctgtggcagtgggaagtcaaggacagagtcaggggagctctgcagctcagactcagggaccagttcaggtcttctgccctcagatagggttctctggataggtgatgttgcttgccagcctatgacacccatccctgaggagacatttctggagctgaagagctttagccagagtgaattcccagacatatgcaaaattgatggtatagtgttcaaccagtgtgagagtgagagtctacctcaaccctttgatgttgcatggatggatgtaggccactctcataaaatcatcatgagggagcacaagactaaatgggtacaagagagctcatctaaggattttgtgtgctacaaggaagggactggcccgtgttctgaatcagaagagaagacttgcaagaccagtggatcatgtaggggggacatgcagttttgcaaggtggcaggttgtgaacacggggaagaggcatctggtgccaagtgtagatgctcactagtgcacaagcccggggaagttgttgtgtcatatggagggatgcgtgtcagaccaaagtgttatggcttctccagaatgatggcaacactagaggtgaacccaccagagcaaaggattggccaatgcactggctgccatctagaatgcataaatgggggtgtgaggctgatcactctgactagtgagctcaagtcagctactgtctgtgcttcccacttttgtagttctgccacaagtggcaagaaaagcacggagattcaattccactcagggtcattagttgggaaaacagcaatacacgtcaaaggggctttggtggatggaactgaattcacatttgagggcagttgcatgttcccagatggttgtgacgcagtggactgcacattctgtcgtgagtttctaaaaaatcctcagtgctatcctgcaaagaaatggttgttcatcatcattgtcatcctccttggatatgcaggcctcatgctactcaccaatgtccttaaggcaatcggggtttggggatcatgggtcatagctccagtgaagctaatgtttgccatcataaagaaactgatgagatccgtgagctgcttgatggggaagttaatggataggggaaggcaagtaatccatgaagaaataggggagaatagagagggcaaccaggatgatgttaggatcgagatggcaagacccagaagggtaaggcattggatgtactcacctgtcatcctgactattctagcaattgggcttgccgaaggctgcgatgagatggtccatgcagactccaaacttgtttcgtgcaagcaggggagcggaaatatgaaggaatgtgtcacaactgggagggcactccttcctgcggtgaacccaggacaagaggcatgtctgcacttcacggcacctgggagtccggactcaaaatgtctcaaaataaaggttaagaggataaacctaaaatgtaagaagtcatcatcatattttgtacctgatgctcggtctaggtgtacatctgtgaggagatgtcgctgggcaggagactgccagtctgggtgcccctctcatttcacgtccaactccttttctgatgattgggcaggtaaaatggacagggcaggtctaggattcagtgggtgctctgatgggtgtggaggagcagcctgcggctgctttaatgcagccccttcatgcatcttttggaggaaatgggtagagaacccgcatgggatcatctggaaagtatctccatgtgctgcatgggtcccatcagctgtcatagagctaacaatgccctcaggggaagtgaggacattccaccccatgagcggcatccctacacaagtcttcaagggtgtgagtgtgacgtacttaggctcagatatggaggtgtctggcttgactgacctgtgtgaaatagaagagctcaagtccaagaagctggcattagctccctgcaatcaggctggcatgggggttgtaggcaaggttggagagatacagtgcagtagcgaggaaagcgcccgtaccataaaaaaagatgggtgtatatggaatgctgaccttgtgggcatagagctacgagtggatgacgctgtgtgctactctaagatcactagtgtggaggcagtcgcaaactactctgccatacccaccactattggggggctgaggtttgagagaagccatgacagccagggtaaaatatctggtagccccctagacatcacagccataagggggtctttttcagttaattatagaggccttcgactgagcctctcagaagttactgctacttgcacaggagaggtaacgaatgtgagtgggtgttactcttgcatgacaggcgccaaagtctccatcaaactgcacagcagtaaaaatagcactgcccatgtaagatgcaaaggggatgagacagcgttcagtgtactagagggagttcatagctatactgtaagtctcagctttgaccatgctgtggtcgatgagcagtgccagctgaactgtggggggcatgagagccaagtgactctaaaaggcaacctcatcttcctggatgtcccaaaatttgtagatggcagctatatgcagacatatcatagttctgtgcccacaggggctaatatcccaagccctacagactggctgaatgccttgtttggcaatgggctgagcaggtggattctgggggtaataggggttctactggggggattggctctctttttcttaatcatgtctttgttcaaattgggaacaaaacaggtatttcgatcaaggacgaagctggcttag

SEQ ID NO: 4734 - RNA, 3222 nt, synthetic construct
  misc_feature 1..3222: note = derived and/or modified CDS sequence (wt) from SFTSV(KADGH)__KU507548.1__GP
  source 1..3222: mol_type = other RNA
atgatgaaagtcatctggttctcctctctgatctgcttagtcatccaatgcagtggggacacgggcccaatcatatgcgcagggcccatccactcaaacaagagtgccaacataccccacctgcttggttactctgagaagatttgtcagatagatcgactgatacatgtttcgtcatggctgagaaaccattcacagtttcagggctacgtggggcagcgaggtggacgctctcaggtgagctactacccagctgaaaactcttactcaaggtggagcggacttctaagcccctgtgatgctgattggcttgggatgcttgtcgtgaagaaggccaaggggtctgatatgatagttcctgggccttcatacaaggggaaagtcttttttgaacggccaacttttgatggatacgtgggctggggctgtggcagtgggaagtcaaggacagagtcaggtgaactctgcagctcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtttagctcagccctttgatgtcgcatggatggatgtaggtcactctcataaaatcatcatgagggagcacaagaccaaatgggtacaagagagctcatctaaggattttgtgtgctacaaggaaggaactgggccgtgttctgaatcagaagaaaagacttgcaagaccagtggatcatgcaggggggatatgcagttttgcaaggtggcaggttgtgaacatggggaagagacatctgtagccaagtgtagatgttctctagtgcacaagcccggggaagttgttgtgtcatatggagggatgcgtgtcagaccaaagtgttatggtttctccagaatgatggcaacactagaggtgaacccaccagagcaaagaattggccaatgcactggctgccatctagaatgcataagtgggggtgtgaggctaatcactctaactagtgagctcaagtcagccactgtctgtgcttcccacttttgtagttctgccacaagtggcaagaaaagcacggagattcaattccactcagggtcattagttgggaaagcagcaatacacgtcaaaggggttttggtggatggaactgaattcacatttgagggcagttgcatgttcccagatggttgtgacgcagtggattgcacattctgtcgtgagtttctaaagaatcctcagtgctaccctgcaaagaaatggttgttcattattattgtcatcctccttggatacgcaggcctcatgctactcaccaatgtccttaaggcaatcggggtttggggatcatgggtcatagctccagtgaagctaatgtttgctatcataaagaaactgatgagatctgtgagctgcttgatggggaaattgatggataggggaaggcaagtgatccatgaagaaataggggagaatagagagggcaaccaagatgatgttaggatcgagatggcaagacccagaagggtgaggcattggatgtactcacctgtcatcctgactattctagcaattgggctagctgagggctgcgatgagatggtccatgctgattctaaacttgtttcgtgcagacaagggagcgggaacatgaaagaatgtgtcacaactgggagggcgctccttcctgcggtgaacccaggacaagaggcatgtctgcacttcacggcacctgggagcccggactcaaaatgtctcaaaatcaaggttaagaggatcaacctaaaatgtaagaagtcatcatcatattttgttcctgatgctcgatccaggtgtacatctgtgaggagatgtcgctgggcaggagactgtcagtctgggtgcccctctcatttcacgtccaactccttctctgatgattgggcaggaaaaatggacagggctggtctaggattcagtgggtgctcagatggatgtggaggagcagcctgcggctgctttaatgcggccccttcatgcatcttttggaggaaatgggtagagaatccacatgggatcatctggaaagtatctccatgtgctgcatgggtcccttcagcagtcatagagctaacgatgccctcgggggaagtgagaacattccaccccatgagcggcatccccacacaagtcttcaagggtgtgagtgtgacttacttaggctcagatatggaggtgtctggcttgactgacctgtgtgagatagaagagctaaagtccaagaagctggcattagctccctgcaatcaggctggcatgggggttgtaggcaaggttggagagatacaatgcagcagcgaggaaagcgcccgtactataaagaaagatgggtgtatatggaatgctgaccttgtaggcatagagctacgggtggatgacgctgtatgctactctaagatcactagtgtggaggcagttgcaaactactctgccatacccaccactattggggggctgaggtttgagaggagccatgacagtcagggtaaaatatctggtagccccctagacatcacagccataagagggtctttttcagttaattatagaggccttcgactgagcctctcagaaattactgctacttgcactggggaggtgacgaatgtgagtgggtgttactcttgcatgacaggcgccaaagtctccatcagactgcatagcagcaaaaatagcactgcccatgtaagatgcaaagaggatgagaccgcgtttagtgtcctggagggagttcacagctatactgtcagtctcagctttgaccacgcagtggtcgatgagcagtgccagctgaactgtggggggcatgagagtcaagtgactctaaaaggcaaccttatcttcctggatgtcccaaaatttgtagatggcagctatatgcagacatatcatagttctgtgcccacaggggctaatatcccaagcccgacagactggctgaatgccttgtttggcaatgggctgagtagatggattctgggggtgataggggttctgctggggggattggctctcttcttcttaatcatgtctttgttcaaactgggaacaaaacaggtatttcgatcaaggacgaagctggcttag

SEQ ID NO: 4735 - RNA, 3222 nt, synthetic construct
  misc_feature 1..3222: note = derived and/or modified CDS sequence (wt) from SFTSV(KAGBH)__KU507560.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgtcagatagatcggctgatacatgtttcgtcatggctgagaaaccattcacaattccagggctacgtggggcagcgaggtggacgctctcaggtgagttacttcccagctgaaaactcttactcaaggtggagtggacttctaagcccctgtgatgctgattggcttgggatgcttgtcgtgaagaaggccaagggatctgatatgatagttcctgggccttcatacaagggaaaagtcttttttgaacggccaacttttgatggatacgtaggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctaaagagttttagccagagtgaattcccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggacagggccgtgttctgaatcagaagaaaagacttgcaagaccagtggatcatgcaggggggacatgcagttttgcaaggtggcaggttgtgaacatggggaagaggcatctgaagccaaatgcagatgctcactagtgcacaagcctggggaagttgttgtgtcatatggagggatgcgtgtcagaccaaagtgctatggtttctccaggatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacatgtcaaaggggcattggtggatggaactgaattcacatttgagggcagttgcatgttcccagatggctgtgacgcagtggactgcactttctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgataagatctgtgagctgcttgatggggaaattgatggataggggaaggcaagtgatccatgaagaaataggagagaacagagagggcaaccaagatgatgttaggatcgagatggcaaggcctagaagggtaaggcactggatgtactcacctgtcatcctgactattctagcaattgggcttgctgagggctgcgatgagatggtccatgcagattctaaacttgtttcgtgcaagcaagggagtggaaatatgaaggaatgtgtcacaactgggagggcgctccttcctgcagtgaacccaggacaagaggcatgtctgcacttcacggcaccagggagtccggactcaaaatgtctcaaaatcaaagttaagaggattaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagctcacaatgccctcaggggaagtgaggacattccaccccatgagcggcatccctacacaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacagtgcagtagcgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggtaaaatatctggtagccccttggacatcacagccataagagggtctttttcagtgaattatagaggccttcgactgagcctatcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagcctcagttttgaccatgcagtggtcgatgagcagtgccagctaaactgtgggggacatgagagtcaagtgactctgaaaggcaacctcatcttcctggatgtcccaaaattcgtagatggcagctacatgcagacatatcatagttctgtgcccactggagcaaatatcccaagccccacagactggctgaatgccctgtttggcaatgggctgagtaggtggattctgggggtgataggggttctactggggggattggctctctttttcttaatcatgtctttgttcaaactgggaacaaaacaggtatttcgatcaaggacgaagctggcttag

SEQ ID NO: 4736 - RNA, 3222 nt, synthetic construct
  misc_feature 1..3222: note = derived and/or modified CDS sequence (wt) from SFTSV(KAGBH3)__KU507561.1__GP
  source 1..3222: mol_type = other RNA
atgatgaaagtcatctggttctcctctctgatctgcttagtcattcaatgcagtggggacacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgttggctggggctgtggcagtgggaagtcaaggactgagtcaggagagctctgcagctcagactcagggaccagttccggtcttctgccctcaaatagggttctctggataggtgatgttgcttgccagcctatgacacccatccctgaagagacatttctggagctgaagagttttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgtaggggggacatgcagttttgcaaggtggcaggttgtgaacatggggaagagacatctgaggccaaatgcagatgctcactagtgcacaagcccggggaagttgttgtgtcatatggagggatgcgtgtcagaccaaaatgctatggtttctccagaatgatggcaacactagaggtgaacccaccagagcaaaggattggccaatgcactggctgccatctagaatgcataaatgggggtgtgaggataatcactctaactagtgagctcaagtcagctactgtctgtgcttcccacttttgtagttctgccacaagtggcaagaaaagcacggagattcaattccactcagggtcattagttgggaaaacagcaattcacgtcaaaggggcattggtggatggaactgaattcacatttgaaggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggcaaggcccagaagggtaaggcactggatgtactcacctgtcatcctgactattctagcaattgggcttgctgagggatgcgatgagatggtccatgcagattctaaacttgttttgtgcaagcaagggagcggaaatatgaaggaatgtgtcacaactgggagggcgctccttcctgcggtgaacccagggcaagaggcatgtctgcacttcacagcaccagggagtccggactcaaaatgtctcaaaatcaaagttaagaggatcaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcgggggaagtgaggacattccaccccatgagcggcatccctactcaagtcttcaagggtgtgagtgtgacttacttgggctcagatatggaggtatctggcttgactgatctgtgtgaaatagaagagctcaagtccaagaagctggcattagctccctgcaatcaggctggcatgggggttgtaggcaaggttggagagatacagtgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggcaaaatatctggtagccccttggacatcacagccataagagggtctttttcagttaactatagaggccttcgactgagcctctcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatgctgtcagcctcagttttgaccatgcagtggtcgatgagcagtgccagctgaactgtggggggcatgagagccaagtgactctaaaaggcaacctcatcttcctggatgtcccaaaattcgtagatggtagctacatgcagacatatcatagctctgtacccacaggagcaaatatcccaagcccaacagactggctgaatgccctgtttggcaatgggctgagtaggtggattctgggggtgataggggttctactggggggattagctctctttttcttaatcatgtctttgttcaaactgggaacaaaacaggtatttcgatcaaggacgaagctggcttag

SEQ ID NO: 4737 - RNA, 3222 nt, synthetic construct
  misc_feature 1..3222: note = derived and/or modified CDS sequence (wt) from SFTSV(KAGBH4)__KU507562.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtgggcgctctcaggtgagttacttcccagctgaaaactcttactcaaggtggagtggacttctaagcccctgtgatgctgattggcttgggatgcttgtcgtgaagaaggccaagggatctgatatgatagttcctgggccttcatacaagggaaaagtcttttttgaacggccaacttttgatggatacgtaggctggggctgtggtagtgggaagtcaaggactgagtcaggagagctctgcagctcagactcagggaccagttccggtcttctgccctcagatagggttctctggataggtgatgttgcttgccagcctatgacacccatccctgaagagacatttctggagctaaagagttttagccagagtgaattcccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaaatgcagatgctcactagtgcacaagcctggggaagttgttgtgtcatatggagggatgcgtgtcagaccaaagtgctatggtttctccaggatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacatgtcaaaggggcattggtggatggaactgaattcacatttgagggcagttgcatgttcccagatggctgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgatgagatctgtgagctgcttgatggggaaattgatggataggggaaggcaagtgatccatgaagaaataggagagaacagagagggcaaccaagatgatgttaggatcgagatggcaaggcctagaagggtaaggcactggatgtactcacctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcagtgaacccaggacaagaggcatgtctgcacttcacggcaccagggagtccggactcaaaatgtctcaaaatcaaagttaagaggattaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggtgcagcctgcggctgctttaatgcggccccttcatgcatcttctggaggaaatgggtggagaatccacatgggatcatctggaaagtatctccatgtgctgcatgggtcccatcagcagtcatagagctcacaatgccctcaggggaagtgaggacattccaccccatgagcggcatccctacacaggtcttcaagggtgtgagtgtgacttacttgggctcagatatggaggtatctggcttgactgacctgtgtgaaatagaagagctcaagtccaagaaactggcattagctccctgcaatcaggctggcatgggggttgtaggcaaggttggagagatacagtgcagtagcgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggtaaaatatctggcagccccttggacatcacagccataagagggtctttttcagttaattatagaggccttcgactgagcctatcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagcctcagttttgaccatgcagtggtcgatgagcagtgccagctaaactgtggggggcatgagagtcaagtgactctgaaaggcaacctcatcttcctggatgttccaaaattcgtagatggcagctacatgcagacatatcatagttctgtgcccacaggagcaaatatcccaagccctacagactggctgaatgccctgtttggcaatgggctgagtaggtggattctgggggtgataggggttctactggggggattggctctctttttcttaatcatgtctttgttcaaactgggaacaaaacaggtatttcgatcaaggacgaagctggcttag

SEQ ID NO: 4738 - RNA, 3222 nt, synthetic construct
  misc_feature 1..3222: note = derived and/or modified CDS sequence (wt) from SFTSV(KAGBH5)__KP663738.1__GP
  source 1..3222: mol_type = other RNA
atgatgaaagtcatctggttctcctctctgatctgcttagtcattcaatgcagtggggacacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggcctttatacaagggaaaagtcttttttgaacggccaacttttgatggatacgttggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctgaagagttttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagcggatcatgtaggggggacatgcagttttgcaaggtggcaggttgtgaacatggggaagagacatctgaagccaaatgcagatgctcactagtgcacaagcccggggaagttgttgtgtcatatggagggatgcgtgtcagaccaaaatgctatggtttctccagaatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcaggtgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcagtcggggtttgggggtcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggcaaggcctagaagggtgaggcactggatgtactcacctgtcatcctggctattctagcaattgggcttgctgagggctgcgatgagatggtccatgcagattctaaacttgtttcgtgcaagcaagggagcggaaatatgaaggaatgtgtcacaactgggagggcgctccttcctgcggtgaacccaggacaagaggcatgtctgcacttcacagcaccagggagtccggactcaaaatgtctcaaaatcaaagttaagaggatcaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcgggggaagtgaggacattccaccccatgagcggcatccctactcaagtcttcaagggtgtgagtgtgacttacttgggctcagatatggaggtatctggcttgactgatctgtgtgaaatagaagagctcaagtccaagaagctggcattagctccctgcaatcaggctggcatgggggttgtaggcaaggttggagagatacagtgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattggggggctgaggtttgagagaagccatgacagccagggcaaaatatctggtagccccttggacatcacagccataagagggtctttttcagttaactatagaggccttcggctgagcctctcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagcctcagttttgaccatgcagtggtcgatgagcagtgccagctgaactgtggggggcatgagagtcaagtgactctaaaaggcaacctcatcttcctggatgtcccaaaattcgtagatggcagctacatgcagacatatcatagttctgtacccacaggagcaaatatcccaagcccaacagactggctgaatgccctgtttggcaatgggctgagtaggtggattctgggggtgataggggttctactggggggattggctctctttttcttaatcatgtctttgttcaaactgggaacaaaacaggtatttcgatcaaggacgaagctggcttag

SEQ ID NO: 4739 - RNA, 3222 nt, synthetic construct
  misc_feature 1..3222: note = derived and/or modified CDS sequence (wt) from SFTSV(KAGBH6)__KP663741.1__GP
  source 1..3222: mol_type = other RNA
atgataaaagtcatctggttctcctctctgatctgcttagtcattcaatgcagtggggatacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaagggatctgatatgatagttcctgggccttcatacaagggaaaagtcttttttgaacggccaacttttgatggatacgtaggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctaaagagttttagccagagtgaattcccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccatgttctgaatcagaagaaaagacttgcaagaccagtggatcatgcaggggggacatgcagttttgcaaggtggcaggttgtgaacatggggaagaggcatctgaagccaaatgcagatgctcactagtgcacaagcctggggaagttgttgtgtcatatggagggatgcgtgtcagaccaaagtgctatggtttctccaggatgatggctacactagaggtgaacccaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacatgtcaaaggggcattggtggatggaactgaattcacatttgagggcagttgcatgttcccagatggctgtgacgcagtggactgcactttctgtcgtgagtttctaaaaaatcctcagtgctaccctgcaaagaaatggttgttcatcattattgtcatcctccttggatatgctggcctcatgctactcaccaatgtccttaaggcaatcggggtttgggggtcatgggtcatagctccagtgaagctaatgtttgccatcataaagaaactgataagatctgtgagctgcttgatggggaaattgatggataggggaaggcaagtgatccatgaagaaataggagagaacagagagggcaaccaagatgatgttaggatcgagatggcaaggcctagaagggtaaggcactggatgtactcacctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcagtgaacccaggacaagaggcatgtctgcacttcacggcaccagggagtccggactcaaaatgtctcaaaatcaaagttaagaggattaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggagcagcctgcggctgctttaatgcggctccttcatgcatcttctggaggaaatgggtagagaatccacatgggatcatctggaaagtatctccatgtgctgcatgggtcccatcagcagtcatagagctcacaatgccctcaggggaagtgaggacattccaccctatgagcggcatccctacacaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacagtgcagtagcgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggtaaaatatctggtagccccttggacatcacagccataagagggtctttttcagttaattatagaggccttcgactgagcctatcagaaatttctgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagcctcagttttgaccatgcagtggtcgatgagcagtgccagctaaactgtggggggcatgagagtcaagtaactctgaaaggcaacctcatcttcctggatgtcccaaaattcgtagatggcagctacatgcagacatatcatagttctgtgcccacaggagcaaatatcccaagccctacagactggctgaatgccctgtttggcaatgggctgagtaggtggattctgggggtgataggggttctactggggggattggctctctttttcttaatcatgtctttgttcaaactgggaacaaaacaggcatttcgatcaaggacgaagctggcttag

SEQ ID NO: 4740 - RNA, 3222 nt, synthetic construct
  misc_feature 1..3222: note = derived and/or modified CDS sequence (wt) from SFTSV(KAGNH)__KU507550.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggctactctgagaagatttgtcagatagatcgactgatacatgtttcgtcatggctgagaaaccattcacaattccagggctacgtggggcggcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtctttttcgaacggccaacttttgatggatacgtaggctggggctgtggcagtgggaagtcaaggactgagtcaggagagctctgcagctcagactcagggaccagttcaggtcttctgccctcagatagggttctctggataggtgatgttgcttgccagcccatgacacccatccctgaagagacatttctggagctgaagagctttagccagagtgaatttccagacatatgcaaaattgatggcattgtgttcaaccagtgtgagagtgagagcctacctcagcccttcgatgttgcttggatggatgttggccactctcataaaatcatcatgagggagcacaagaccaaatgggtacaagagagctcatccaaggattttgtgtgctacaaggaggggactgggccgtgttctgaatcagaagaaaagacttgcaagaccagtggatcatgcaggggggacatgcagttttgcaaggtggcaggttgtgaacatggggaagaggcatctgaagccaagtgcagatgctcactagtgcacaagcccggggaagttgttgtgtcatatggagggatgcgtgtcagaccaaagtgttatggtttctccagaatgatggcaacactagaggtgaacccaccagagcaaaggattggccaatgcactggctgccatctagaatgcataaatgggggtgtgaggctaatcactctaactagtgagctcaagtctgctactgtctgtgcttcccacttttgcagttctgccacaagtggcaagaaaagcacggaaattcaattccactcagggtcattagttgggaaaacagcaatacacgtcaaaggggcattagtggatggaactgaattcacatttgagggcagttgcatgttcccagacggttgtgacgcagtggactgcacattttgtcgtgagtttctaaaaaatcctcagtgctaccctgcaaagaaatggttgttcatcattattgtcatcctcctcgggtatgcaggcctcatgctactcaccaatgtccttaaagcaatcggggtctggggttcatgggtcatagctccagtgaagctaatgtttgccatcataaagaaactgattagatctgtgagctgcttgatggggaaattgatggataggggaaggcaagtgatccatgaagagataggggagaatagagagggcaaccaagatgatgttaggatcgagatggcaaggcctagaagggtgaggcactggatgtactcacctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcggtgaacccaggacaagaggcatgtctgcacttcacggcaccagggagtccggactcaaaatgtctcaaaattaaagttaagaggattaacctgaaatgcaagaagtcatcatcatatttcgttcctgacgctcggtccaggtgtacatctgtgaggagatgccgctgggcaggagactgtcagtctgggtgcccctctcatttcacgtccaactccttctctgatgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggttccatcagcagtcatagagctaacaatgccctcaggggaagtgagaacattccaccccatgagcggcatccctacacaagtcttcaagggtgtgagtgtaacttacttgggctcagatatggaggtatctggcttgactgacctgtgtgaaatagaagagctcaaatccaagaagctggcactagctccctgcaatcaggcaggcatgggggttgtaggcaaggttggagagatacagtgcagtagcgaggaaagtgcccgtaccataaaaaaagatgggtgtatatggaatgctgacctcgtgggcatagagctacgagtggatgacgctgtatgctactctaagatcactagtgtggaggcagtagcaaactactctgccatacccactactattgggggactaaggtttgagagaagccacgacagccagggtaaaatatctggtagccccttggacatcacagccataagagggtctttttcagttaattatagaggccttcgactgagcctctcagaaatcactgctacttgcacaggggaggtgacaaatgtgagtgggtgttactcttgcatgacaggcgccaaaatctccatcaaactgcatagcagcaaaaatagcactgcccatgtaagatgtaaaggggatgagactgcgttcagtgtcctggagggtgttcatagctatactgtcagtctcagctttgaccatgcggtggtcgatgagcagtgccagctaaactgtgggggacatgagagtcaagtgacactaaaaggcaacctcatcttcctggatgtcccaaaatttgtagatggcagctacatgcagacatatcatagttctgtacccacaggagcaaatatcccaagccctacagactggctgaatgccctgtttggcaatgggctgagtaggtggattctgggggtgataggggttctactggggggattggctctctttttcttaatcatgtctttgttcaaactgggaacaaatcaggtatttcgatcaaggacgaagctggcttag

SEQ ID NO: 4741 - RNA, 3222 nt, synthetic construct
  misc_feature 1..3222: note = derived and/or modified CDS sequence (wt) from SFTSV(KAGNH4)__KU507551.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagtccctgtgatgctgattggcttgggatgcttgtcgtgaagaaggccaaggggtctgatatgatagttcctgggccttcatacaaggggaaagtcttttttgagcggccaacttttgatggatacgtaggctggggctgtggcagtgggaagtcaaggactgagtcaggagagctctgcagctcagactcagggaccagttcaggtcttctgccctcggatagggttctctggataggtgatgttgcttgccagcctatgacacccatccctgaagagacatttctggagctgaagagttttagccagagtgaattcccagacatatgcaaaattgatggcattgtgttcaaccagtgtgagagcgagagcctacctcagccctttgatgttgcttggatggatgttggccactctcataaaatcatcatgagggagcataagaccaaatgggtgcaagagagctcatctaaggattttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtacataagcccggggaagttgttgtgtcatatggagggatgcgtatcagaccaaagtgctatggtttctccagaatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagttccgccacaagtggcaagaaaagcacggagattcaattccactctgggtcattagttgggaaaacagcaatacacgtcaaaggggcattggtggatggaactgaattcacatttgagggcagctgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtcctcaaggcaatcggggtttgggggtcatgggtcatagccccagtgaagctaatgtttgccatcataaagaaactgatgagatctgtgagctgcttgatggggaaattgatggatagggggaggcaagtgatccatgaagaaataggggagaatagagagggcaaccaagatgatgttaggatcgagatggcaaggcctagaagggtaaggcactggatgtactcacctgtcatcctgactattctagcaattgggcttgctgggggctgcgatgagatggtccatgcagattctaaacttgtttcgtgcaggcaagggagcgggaacatgaaggaatgtgtcacaactgggagggcgctccttcctgcggtgaacccaggacaagaggcatgtctgcacttcacggcaccagggagtccggactcaaaatgtctcaaaatcagagttaagaggattaacctgaaatgcaagaagtcatcttcatatttcgttcctgatgctcggtccaggtgtacatctgtgaggagatgccgctgggcaggagactgtcagtctgggtgcccctctcatttcacgtctaactccttttctgacgattgggcaggcaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcaggggaagtgaggacattccaccccatgagcggcatccctacacaagtcttcaagggtgtgagtgtgacttacttgggctcagatatggaggtgtctggcttgactgacctgtgtgaaatagaagagctcaagtccaggaaactggcattagctccctgcaatcaggctggcatgggggttgtaggcaaggttggagagatacagtgcagtagcgaggaaagtgcccgtaccataaaaaaagatgggtgtatttggaatgctgacctcgtgggcatagagctacgagtggatgacgctgtgtgctactctaagatcactagtgtggaggcagttgcaaactactctgccatacccaccactattgggggactgaggtttgagagaagccatgacagccagggtaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggtgccaaagtctccatcaaactgcatagcagcaaaaatagcactgcccatgtaagatgcaaaggggatgagactgcgttcagtgtcctggagggagttcatagctatactgtcagtctcagctttgaccatgcagtggttgatgagcagtgccagctgaactgtgggggacatgagagtcaagtgactctaaaaggcaacctcatcttcctggatgtcccaaaatttgtagatggcagctacatgcagacatatcatagttctgtgcccacaggagcaaatatcccaagccctacagactggctgaatgccctgtttggcaatgggctgagtaggtggattctgggggtgataggggttctactggggggattggccctctttctcttaatcatgtctttgttcaaactgggaacaaaacaggtatttcgatcaaggacgaagctggcttag

SEQ ID NO: 4742 - RNA, 3222 nt, synthetic construct
  misc_feature 1..3222: note = derived and/or modified CDS sequence (wt) from SFTSV(KAGWH2)__KU507564.1__GP
  source 1..3222: mol_type = other RNA
atgatgaaagtcatctggttctcctctctgatctgcttagtcattcaatgcggtggggatacgggcccaatcatctgcgcaggacccatccactcaaacaagagtgctggcataccccacctgcttggctactctgagaagatttgtcagatagatcggctgatacatgtttcgtcatggctcagaaaccactcacaatttcagggctacgtagggcagcgaggtggacgctctcaggtgagctactacccggctgaaaattcttactcaaggtggagtggacttctaagcccctgtgatgctgattggcttgggatgcttgtcgtgaagaaggccaaggggtctgatatgatagttcctgggccctcatacaaggggaaagtcttttttgaacggccaacttttgatggatacgtaggctggggttgtggtagtgggaagtctaggactgagtcaggtgagctctgcagttcagactccgggactagctctggtcttctgccctcggatagggttctctggataggtgatgttgcttgtcagcctatgacacccatccctgaggagacatttctggagctgaagagctttagccaaagtgaattcccagatgtatgcaaaattgatggcattgtgttcaaccagtgtgagggtgagagtctacctcagccctttgatgttgcatggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgcagatgctcacttgtgcacaagcccggggaagtcgttgtgtcatatggagggatgcgtgtcagaccaaagtgctatggattctccagaatgatggcaacactggaggtgaacccaccagagcaaaggattggtcaatgcactggctgccatctagaatgcataaatggaggtgtgaggctaatcactctaaccagtgagctcaagtcagctactgtctgcgcttctcacttttgtagttctgccacaagtggtaagaaaagcacggagattcaattccactcaggatcattggttggaaaaacagcaatccacgtcaaaggggcattggtagatggaactgaattcacatttgagggtagctgcatgttcccagatggttgtgatgcagtggactgcacattctgtcgtgagtttctaaaaaatcctcagtgctaccctgcaaagaagtggctgttcatcattattgtcatcctcctaggatatgcaggcctcatgctactcaccaatgttcttaaggcaattggggtttgggggtcatgggtcatagctccagtgaagctagtgtttgccatcataaagaaactaatgagagctgtgagctgcctgatggggaaattgatggataggggaaggcaagtgatccatgaggaaataggggagaatagagagggcaaccaagatgatgttaggatcgagatggccaggcccaggagggtaaggcattggatgtactcgcctgtcatcctgactattctagcaattgggcttgctgagggctgtgatgagatggtccatgctgattctaaacttgtttcgtgcaggcaagggagcggaaatatgaaggaatgtgttacaactgggagggcgcttcttcctgcggtgaaccctgggcaagaggcgtgtctgcacttcacggcacctggaagtccggactcaaaatgtctcaaaattaaggttaagaggatcaacctaaaatgtaagaagtcatcatcatattttgttcctgatgcccggtccaggtgcacatcagtgaggagatgtcgttgggcaggggactgccagtctgggtgcccccctcatttcacatccaactccttttctgatgattgggcaggtaagatggacagggctggtctaggattcagtggctgctctgatgggtgtggaggagcagcctgcggttgctttaatgcggccccttcatgcattttctggaggaaatgggtagagaatccacatgggatcatctggaaagtatctccatgtgccgcatgggtcccatcagcagttatagagctaacaatgccctcaggggaggtgaggacattccaccccatgagcggaatccccacacaagtcttcaagggtgtgagtgtaacttacttgggctcagacatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaagaaagatgggtgcatatggaatgctgacctcgtgggtatagagctacgagtggatgacgctgtgtgctactctaagatcactagtgtggaggcagttgcaaactactccgccatacccaccactattggggggctgaggtttgagagaagccatgacagccagggtaaaatatctggaagccccctggacatcacagctataagaggatccttttctgttaattatagaggccttcgactgagtctctcagaaattactgctacttgcacaggggaagtgacaaatgtgagtgggtgttattcttgtatgacaggcgccaaagtctctatcaaattgcatagcagcaaaaatagcactgcccatgtaagatgcaaaggggatgagactgcattcagtgtcttggagggagtccatagctactctgtcagtctaagttttgatcatgcagtcgtcgatgagcagtgccaactgaactgtgggggacatgagagtcaagtgactctaagaggcaacctcatcttcctggatgtcccgaaatttgtggatggcagctacatgcagacatatcatagtactgtgcccacaggggcaaatatcccaagccctacagattggctgaatgccttgtttggcaatgggctgagtaggtggatccttggggtgataggggtcctactgggggggttggctctctttttcttgatcatgtctttgttcaagctgggaacaaaacaggtatttcgatcgaggacgaagctggcttag

SEQ ID NO: 4743 - RNA, 3222 nt, synthetic construct
  misc_feature 1..3222: note = derived and/or modified CDS sequence (wt) from SFTSV(KAGWH3)__KP663735.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccatctgcttggttactctgaaaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttatcgtgaagaaggccaagggatctgatatgatagttcctgggccttcatacaagggaaaagtcttttttgaacggccaacttttgatggatacgtaggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctaaagagttttagccagagtgaattcccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaaatgcagatgctcactagtgcacaagcctggggaagttgttgtgtcatatggagggatgcgtgtcagaccaaagtgctatggtttctccaggatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagctctgccacaagtggcaagaaaagcacggagattcaattccactcagggtcattagttgggaaaacagcaatacatgtcaaaggggctttggtggatggaactgaattcacatttgagggcagttgcatgttcccagatggctgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgatgagatctgtgagttgcttgatggggaaattgatggataggggaaggcaagtgatccatgaagaaataggagaggtcagagagggcaaccaagatgatgttaggatcgagatggcaaggcctagaagggtaaggcactggatgtactcacctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcagtgaacccaggacaagaggcatgtctgcacttcacggcaccagggagcccggactcaaaatgtctcaaaatcaaagttaagaggattaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggagaaaatgggtagagaatccacatgggatcatctggaaagtatctccatgtgctgcatgggtcccatcagcagtcatagagcttacaatgccctcaggggaagtgaggacattccaccccatgagcggcatccctacacaagtcttcaagggtgtgagtgtgacttacttgggctcagacatggaggtatctggcttgactgacctgtgtgaaatagaagagctcaagtccaagaagctggcattagctccctgcaatcaggctggcatgggggttgtaggcaaggttggagagatacagtgtagtagcgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactatcgggggactgaggtttgagagaagccatgacagtcagggtaaaatatctggtagccccttggacatcacagccataagagggtctttttcagttaattatagaggccttcgactgagcctatcagaaattactgctacctgcacaggggaggtgacaaatgtgagtgggtgttactcttgcatgacaggcgccaaagtctccatcaaactgcatagcagcaaaaatagcactgcgcatgtaaggtgcaaaggggatgagactgcgttcagtgtcctggagggagttcatagctatactgtcagcctcagttttgaccatgcagtggtcgatgagcagtgccagctaaactgtggggggcatgagagtcaagtgactctgaaaggcaacctcatcttcctggatgtcccaaaattcgtagatggcagctacatgcagacatatcatagttctgtgcccacaggagcaaatatcccaagccctacagactggctgaatgccctgtttggcaatgggttgagtaggtggattctgggggtgataggggttctactggggggattggctctcttcttcttaatcatgtctttgttcagactgggaacaaaacaggtatttcgatcaaggacgaagctggcttag

SEQ ID NO: 4744 - RNA, 3222 nt, synthetic construct
  misc_feature 1..3222: note = derived and/or modified CDS sequence (wt) from SFTSV(KAICH)__KU507565.1__GP
  source 1..3222: mol_type = other RNA
atgatgaaagtcatctggttctcctctctgatctgcttagtcattcaatgcggtggggacacgagcccaatcatctgcgcaggacccatccactcaaacaagagtgctgacataccccacctgcttggctactctgagaagatttgtcagatagatcggctgatacatgtttcgtcatggcttagaaaccactcacaatttcagggctacgtagggcagcgaggtggacgctctcaggtgagctactacccagctgaaaattcttactcaaggtggagtggacttctaagcccctgtgatgctgattggcttgggatgcttgttgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactctgggactagttctggtcttctgccctcggatagggttctctggataggtgatgttgcttgtcagcctatgacacccatccctgaggagacatttctggagctgaagagctttagccaaagtgaattcccagacatatgcaaaattgatggcattgtgttcaaccagtgtgagggtgagagtctacctcaaccctttgatgttgcgtggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagcccggagaagtcgttgtgtcatatggagggatgcgtgtaagaccaaagtgctatggtttctccagaatgatggcaacactggaggtgaaccaaccagagcaaaggattggtcaatgcactggctgccatctagaatgcataagtgggggtgtgaggctgatcactctaaccagtgagctcaagtcagctactgtctgcgcttctcacttttgtagttctgccacaagtggtaagaaaagcacggagattcaattccactcaggatcattggttgggaaaacagcaatccacgtcaaaggggcactggtagatggaactgaattcacatttgagggtagttgcatgtttccagatggttgtgatgcagtggactgcacattctgtcgtgagtttctaaaaaatcctcagtgctaccctgcaaagaagtggctgttcatcattattgtcatcctccttggatatgcaggcctcatgctactcaccaatgttcttaaggcaattggggtttgggggtcatgggtcatagctccagtgaagctagtgtttgccatcataaagaagctaatgagagctgtgagctgcctgatggggaaattgatggataggggaaggcaagtgatccatgaggaaataggggagaatagagagggcaaccaagatgatgttaggatcgagatggccagacccaggagggtaaggcattggatgtactcgcctgtcatcctgactattctagcaatagggcttgctgagggctgtgatgaaatggtccatgctgattcaaaacttgtttcgtgcaggcaagggagcggaaatatgaaggaatgtgtcacaactgggagggcgcttcttcctgcggtgaacccagggcaagaggcgtgtctgcacttcacggcacctggaagtccagactcaaaatgtctcaaaattaaggttaagaggatcaacctaaaatgtaagaagtcatcatcatattttgttcctgatgcccggtccaggtgtacatcagtgaggagatgtcgttgggcaggagactgccagtctgggtgcccccctcatttcacatctaactccttttctgatgattgggcaggtaagatggacagggctggtctaggattcagcggctgctctgatggatgtggaggagcagcctgcggttgctttaatgcggccccttcatgcattttctggaggaaatgggtagagaatccacatgggatcatctggaaagtatctccatgtgccgcatgggtcccatcagcagtcatagagctaacaatgccctcaggggaggtgaggacattccaccccatgagcggaatccccacacaagtcttcaagggtgtgagtgtaacttacttgggctctgatatggaggtgtcaggcttgactgacctgtgtgagatggaagagctcaagtcaaaaaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggtatagagctacgagtggatgacgctgtgtgctactctaagatcactagtgtggaggcagttacaaactactccgccatacccaccactattggggggctgaggtttgagagaagccatgacagccagggtaaaatatctggtagccccctggacatcacagctataagaggatctttttctgtcaattacagaggccttcgactgagtctctcagaaattactgctacttgtacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtaaagtgactctaagaggcaacctcatcttcctggatgtcccgaaatttgtggatggcagctacatgcagacatatcatagtacagtgcccacaggggcaaatatcccaagccctacagattggctaaatgccttgtttggcaatgggctgagtaggtggtttctgggagtaataggggtcctactggggggattggctctctttttcttgatcatgtctttgttcaagctgggaacaaaacaagtatttcgatcgaggtcgaagctggcttag

SEQ ID NO: 4745 - RNA, 3222 nt, synthetic construct
  misc_feature 1..3222: note = derived and/or modified CDS sequence (wt) from SFTSV(KAJJH)__KU507566.1__GP
  source 1..3222: mol_type = other RNA
atgatgaaagtcatctggttctcctctctgatctgcttagtcattcaatgcagtggggacacgggcccaatcatatgcgcaggacccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtaagttactacccagctgaaaactcttactcaaggtggagtggacttctaagcccctgtgatgctgattggcttgggatgcttgtcgtgaagaaggccaaggggtctgatatgatagtccctgggccttcatacaaggggaaagtcttttttgaacgtccaacttttgatggatacgtgggctggggctgtggcagtgggaagtcaaggacagagtcaggtgagctctgtagctcagactcagggaccagttctggtcttctgccctccaatagggttctctggataggtgatgttgcttgccagcccatgacacccatccctgaggagacatttctagagctgaagagtttcagccagagtgaattcccagacatatgcaaaattgatggcattgtgttcaaccagtgtgagagtgagagcctacctcagccctttgatgtcgcatggatggatgtaggtcactctcataaaatcatcatgagggagcacaagaccaaatgggtacaagagagctcatccaaggattttgtgtgctacaaggaagggactgggccgtgttctgaatcagaagaaaggacttgcaagaccagtggatcatgcaggggggacatgcagttttgcaaggtcgcaggttgtgaacatggggaagaggcatctgaagccaagtgtagatgctccctagtgcacaagcccggggaagttgttgtatcatatggagggatgcgtgtcagaccaaagtgttatggtttctccagaatgatggcaacactagaggtgaacccaccagagcaaagaattggccaatgcactggctgccatatagaatgcataaatgggggtgtgaggctaatcactctaactagtgagctcaagtcagcaactgtctgtgcttcccacttttgtagttctgccacaagtggcaagaaaagcacggagattcaattccactcaggatcattagttgggaaagctgcaatacatgtcaaaggggctttggtggatggaactgaattcacatttgagggcagttgcatgtttccagatggttgtgacgctgtggactgcacattctgtcgtgagttcctaaaaaatcctcagtgctaccctgcaaagaaatggttgttcattattattgtcatcctccttggatatgcaggcctcatgctactcaccaatgtccttaaggcaatcggggtttggggatcatgggtcatagctccagtgaagctaatgtttgccatcataaagaaacttatgagatctgtgagctgcttgatggggaaattgatggataggggaaggcaagtgatccatgaagaaataggggagaatagagagggcaaccaagatgatgttaggatcgagatggcaagacccagaagggtgaggcattggatgtactcacctgtcatcctgactattctagcaattgggctcgctgagggctgcgatgagatggtccatgcagattctaaacttgtgtcgtgcaggcaagggggcggaaatatgaaggaatgtgtcacaactggaagggcgctccttcctgcagtgaacccaggacaagaggcatgtctgcacttcacggctcctgggagtccggactcaaaatgtctcaaaatcaaggttaagaggatcaacctaaaatgtaagaagtcatcatcatattttgttcctgatgctcggtccaggtgtacatctgtaaggagatgtcgctgggcaggagactgtcagtctgggtgcccctctcatttcacgtccaactccttctctgatgattgggcaggtaaaatggacagggctggtctaggattcagtgggtgctctgatggatgtggaggagcagcctgcggctgctttaatgcggccccttcatgcatcttttggagaaaatgggtagagaatccacatgggatcatctggaaagtatccccatgtgctgcatgggtcccttcagcagtcatagagctaacaatgccctcgggggaagtgaggacattccaccccatgagcggcatccccactcaagtcttcaagggtgtgagtgtgacttacttaggctcagatatggaggtgtctggcttgaccgacctgtgtgagatagaagaactcaagtccaagaagctggcattagctccctgcaatcaggctggcatgggggtcgtaggcaaggttggagagatacagtgcagtagcgaggaaagcgcccgtaccataaagaaagatgggtgtatatggaatgctgaccttgtgggcatagagctacgagtggatgacgctgtgtgctactctaagatcactagtgtggaggcagttgcaaactactctgccatacccaccactattggggggctgaggtttgagagaagccatgacagccagggtaaaatatctggtagccccctagacatcacagctataagagggtccttttcagttaattatagaggccttcgactgagcctctcagaaattactgctacttgcacaggagaggtgacgaatgtgagtgggtgttactcttgcatgacaggcgccaaagtctccatcaaactgcatagcagcaaaaatagcactgcccatgtgagatgcaaaggggatgagaccgcattcagtgtcctggagggagttcatagctatactgtcagtctcagctttgatcatgcagtggtcgatgagcagtgccaactgaactgtggagggcatgagagtcaagtgactctaaagggcaacctcatcttcctggatgtcccaaaatttgtagatggcagctatatgcagacatatcatagttctgtgcccacaggggctaatatcccaagcccaacagactggctgaatgccttgtttggcaatgggctgagtaggtggattctgggggtgataggggttctactggggggattggctctcttcttcttaatcatgtctttgttcaaactggggacaaaacaggtatttcgatcaaggacaaagctggcttag

SEQ ID NO: 4746 - RNA, 3222 nt, synthetic construct
  misc_feature 1..3222: note = derived and/or modified CDS sequence (wt) from SFTSV(KAJNH2)__KU507552.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgactggcttgggatgcttgtcttgaagaaggccaaggagtctgatatgatagttcctgggccttcatacaaggggaaagtcttttttgaacggccaacttttgatggatacgtgggctggggctgtggcagtgggaagtcaaggacagagtcaggtgagctctgcagctcagactcagggaccagttctggtcttctgccctcagatagagttctctggataggtgatgttgcttgccagcctatgacacctatccctgaggagacatttctggaactgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaagagagctcatctaaggattttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagctaagtgtagatgctcactagtgcacaagcccggggaagttgttgtgtcatatggagggatgcgtgtcaggccaaagtgttatggtttctccagaatgatggcaacactggaggtgaacccaccagagcaaaggattggccaatgcactggctgccatctagaatgcataaatgggggtgtaaggctaatcactctaactagtgagctcaagtcagctactgtctgtgcctcccacttttgtagttctgccacaagtggcaagaaaagcacggagattcaattccactcagggtcattagttgggaaagcagcaatacacgtcaaaggggctttggtggatggtacagaattcacatttgagggcagttgcatgttcccagatggttgtgacgcagtggactgcacattctgtcgtgagtttctaaaaaatcctcagtgctaccctgcgaagaaatggttgttcattattattgtcatcctccttggatatgcaggcctcatgctactcaccaatgtccttaaggcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccgagatgatgttaggatcgagatggcaagacccagaagggtgaggcattggatgtactctcctgtcatcctgactattctagcaattgggcttgctgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgcaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggacagggctggtctagggttcagtgggtgctctgatgggtgtggaggagcggcctgcggctgctttaatgcagccccttcatgcatcttttggaggaaatgggtagagaatccacatgggatcatctggaaagtatctccatgtgctgcatgggtcccatcagcagtcatagagctaacaatgccctcgggggaagtgaggacattccaccccatgagcggcatccccacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtgggcaaggttggagagatacagtgcagtagcgaggaaagcgctcgtaccataaagaaagatgggtgtatatggaatgctgaccttgtgggcatagagttacgagtggatgatgctgtgtgctactctaagatcactagtgtggaggcagttgcaaactactctgccatacccaccactattggggggctgaggtttgagagaagccatgacagccagggtaaaatatctggtagccccttagacatcacagccataagagggtctttttcagttaattatagaggccttcgactgagcctctcagaaatcactgctacttgcacaggagaggtgacgaatgtgagtggatgttattcttgcatgacaggtgccaaagtctccatcaagctgcatagcagcaaaaatagcactgcccatgtgaggtgcaaaggggatgagaccgcgttcagtgtcctggaaggggttcatagctatactgtcagtctcagctttgaccatgcagtggtcgatgagcagtgccagctgaactgtggggggcatgagagtcaagtgactctaaaaggcaacctaatcttcctggatgtcccaaaatttgttgatggcagctatatgcagacatatcatagttctgtgcccacaggggctaatatcccaagcccaacagactggctgaatgccttgtttggcaatgggctgagtaggtggattctgggggtgataggggttctactggggggattggccctcttcttcttaatcatgtctttgttcaaactgggaacaaaacaggtatttcgatcaagggcgaagctggcttag

SEQ ID NO: 4747 - RNA, 3222 nt, synthetic construct
  misc_feature 1..3222: note = derived and/or modified CDS sequence (wt) from SFTSV(ZL13-32)__KU361342.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtggaaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcatcattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatacccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4748 - RNA, 3222 nt, synthetic construct
  misc_feature 1..3222: note = derived and/or modified CDS sequence (wt) from SFTSV(AHL/China/2011)__JQ670930.1__GP
  source 1..3222: mol_type = other RNA
atgatgaaagtcatctggttctcctctctgatctgcctagtcattcaatgcagtggggatacgggcccaatcatctgcgcaggacccatccactcaaataagagtgctgacataccccacctgctgggttactctgagaagatttgtcagatagatcggctgatacatgtttcgtcatggctcagaaaccactcacaatttcagggctacgtagggcagcgaggtggacgctctcaggtgagctactacccagctgaaaattcttactcaaggtggagtggacttctaagcccctgtgatgctgattggctagggatgcttgtcgtgaagaaggccaaggggtctgatatgatagttcctggaccttcatataagggaaaagtcttttttgaacggccaacttttgatggatacgtaggctggggctgtggcagtgggaagtctaggactgagtcaggtgagctctgtagttcagactcagggactagttctggtcttctgccctcggatagggttctctggataggtgatgttgcttgtcagcctatgacacccatccctgaggagacatttctggagctgaagagctttagccaaagtgaattcccagacatatgcaaaattgatggaattgtgttcaaccagtgtgagggtgagagtctacctcagccctttgatgttgcatggatggatgttggtcactctcataaaatcatcatgagggagcacaaaaccaaatgggttcaagagagctcatctaaggattttgtgtgctacaaggaggggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagcccggggaagtcgttgtgtcatatggagggatgcgtatcagaccaaagtgctatggtttctccagaatgatggcaacactggaggtgaacccacccgagcaaaggattggtcaatgcacaggctgccatctagaatgcataaatgggggtgtgaggctaatcactctaaccagtgagctcaagtcagctactgtctgcgcatctcacttttgtagttctgccacaagtggcaagaaaaacacggagattcaattccactcaggatcgctggttgggaaaacagcaatacatgtcaagggggcattggtagatggaactgacttcacttttgagggcagctgcatgttcccagatggatgtgatgcagtggactgcacattctgtcgtgagtttctaaaaaatcctcagtgctaccctgcaaagaagtggctgttcatcattattgtcatcctccttggatatgcaggcctcatgctactcaccaatgtccttaaggcaattggggtttggggatcatgggtcatagctccagtgaagctaatgtttgccatcatgaagaaactaatgagatctgtgagctgcttgatggggaaattgatggacaggggaaggcaagtgatccatgaggaaataggggagaatagagagggcaaccaagatgatgttaggatcgagatggcaagacccaggagggtaaggcattggatgtactcacctgtcatcctgactattctagcaacagggcttgctgagggctgtgatgagatggtccatgctgattctaaacttgtttcatgcaggcaagggagcggaaatatgaaggaatgtgtcacaactgggagggcgcttcttcctgcagtgaacccaggacaagaggcatgtctgcacttcacggcacctgggagtccggactcaaaatgtctcaagatcaaggttaagaggatcaacctaaaatgcaaaaagtcatcatcatattttgttcctgatgctcggtccaggtgtacatcagtgaggagatgtcgttgggcaggagactgccagtctgggtgcccccctcatttcacatccaattccttttctgatgattgggcaggtaagatggacagggctggtctgggattcagtggctgctctgatggatgtggaggagcagcctgcggctgcttcaatgcggccccttcatgcatcttctggaggaaatgggtagagaatccacatgggatcatctggaaagtgtctccatgtgccgcatgggtcccatcagcagtcatagaactaacaatgccctcaggggaggtgaggacattccaccccatgagcggcatccccacacaagtcttcaagggtgtgagtgtaacttacttgggctcagatatggaggtgtctggcttgactgacctgtgtgagatagaagagctcaagtcgaagaagctggcattagctccctgcaatcaggctggcatgggggttgtaggcaaggttggagagatacagtgcagtagcgaggaaagtgcccgtaccataaaaaaagatgggtgcatatggaatgctgacctcgtgggtatagagttacgagtggatgatgctgtgtgctactctaagatcactagtgtggaggcagttgcaaactactccgccatacccaccactattggggggctgaggtttgagagaagccatgacagccagggcaaaatatctggtagccccctagacatcacagccataagagggtctttttctgtcaattatagaggccttcggctgagtctctcagaaattactgctacttgtacaggggaagtgacaaatgtgagtgggtgttattcttgcatgacaggggccaaagtctccgtcaaattgcatagcagcaaaaatagtactgcccacgtaagatgcaaaggggatgagactgcattcagtgtcttggagggagtccatagctacactgtcagtctcagctttgatcatgcagtagtcgatgagcagtgccaactgaactgtgggggacatgagagtcaagtgactctaaaaggcaacctcatcttcttggatgtcccaaaatttgttgatggtagctacatgcagacatatcatagtactgtgcccacaggggcaaatatcccaagccccacagattggctgaatgccttgtttggcaatgggctgagcaggtggattctgggggtgataggggtcctactggggggattggctctctttttcttgatcatgtctttgttcaagctgggaacaaaacaggtatttcgatcaaggacgaagctggcttag

SEQ ID NO: 4749 - RNA, 3222 nt, synthetic construct
  misc_feature 1..3222: note = derived and/or modified CDS sequence (wt) from SFTSV(AH-YTY/China/05/2012)__KR017849.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtctcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggttgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgtaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaacctgagcaaaggattggtcaatgcactggctgccatctggaatgcataaatgggggtgtgaggctaataactctaaccagtgagctcaagtcagctactgtctgtgcttcccacttttgtagttctgccacaagtggcaagaaaagcacggagattcaattccactcaggatcattggttgggaaaacagcaatacacgtcaaaggggcattggtagatggaacagaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagagctgtgagctgcttgatggggaaattgatggataggggaaggcaagtgatccatgaggagataggggagaatagagagggcaaccaggatgatgttaggattgagatggcaagacctagaagggtaaggcattggatgtactcacctgtcatcctgactattttagcaatagggcttgctgagagctgtgatgagatggtccatgctgattctaagcttgtctcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtttagggttcagtggctgctctgatgggtgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattggctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgctcatgtaagatgcaaaggggatgagactgcattcagtgtcttggagggggtccatagctacactgtcagtctcagttttgatcatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctgcttggggggttggctctcttttttatgattatgtctttgttcaagctgggaacaaaacaggtatttcgatcaaggacgaagctggcttag

SEQ ID NO: 4750 - RNA, 3222 nt, synthetic construct
  misc_feature 1..3222: note = derived and/or modified CDS sequence (wt) from SFTSV(AHZ/China/2011)__JQ670931.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatacttgtcgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctaaagagttttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgtaagatagcaggttgtgaacatggggaagaggcatctgaagccaagtgtagatgctcacttgtgcacaagcccggagaagtcgttgtatcatatggagggatgcgtgtcagaccaaagtgctatggtttctccagaatgatggcaacactggaggtgaaccaacctgagcaaaggattggtcaatgcactggctgccatctggaatgcataaatgggggtgtgaggctaataactctaaccagtgagctcaagtcagctaccgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcatcattgtcatcctacttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggtaaccaagatgatgttaggattgagatggcaaggcccagaagggtgaggcattggatgtactcacctgtcatcctgactattttagcaataggacttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagcccggactcaaaatgtctcaaaattaaggttaagtggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctatcaatgccctcaggggaggtgaggacattccaccccatgagtggcatccccacacaagtcttcaagggtgtgagtgtgacttacttgggctcagatatggaggtgtctggcttgactggcctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaatcagttgcaaactactctgccatacccaccactattggggggctgaggtttgagagaagccatgacagccagggcaaaatatctggtagccccctggacatcacagctataagaggatctttttctgtcaattatagaggccttcgactgagcctctcagaaattactgctacctgcacaggggaggtgacaaatgtgagtggatgttattcttgcatgacaggcgccaaagtctctattaaactgcacagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctggggttgataggggttctgcttggggggttggctctctttttcatgattatgtctttgttcaagctgggaacaaaacaggtatttcgatcaaggacgaagctggcttag

SEQ ID NO: 4751 - RNA, 3222 nt, synthetic construct
  misc_feature 1..3222: note = derived and/or modified CDS sequence (wt) from SFTSV(DS02/CHN/2013)__KR698332.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgaacggccaacttttgatggatacgtgggctggggctgtggcagtgggaagtcaaggacagagtcaggtgagctctgcagctcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcccggggaagttgttgtgtcatatggagggatgcgtgtcaggccaaagtgttatggtttctccagaatgatggcaacactggaggtgaacccaccagagcaaagaattggccaatgcactggctgccatctagaatgcataaatgggggtgtgaggctagtcactctaactagtgagctcaagtcagctactgtctgtgcttcccacttttgtagttctgccacaagtggcaagaaaagcacggagattcaattccattctgggtcattagttgggaaagcagcaatacacgtcaaaggggctttggtggatggtacagaattcacatttgagggcagttgcatgttcccagatggttgtgacgcagtggactgcacattctgtcgtgagtttctaaaaaatcttcagtgctaccctgcaaagaaatggttgttcattattattgtcatcctccttggatatgcaggcctcatgctactcaccaatgtccttaaagcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggtaagacccaggagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgtaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccaccccatgagcggcatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgcaaactactctgccataccaaccactattggggggctgaggtttgagagaagccatgacagccagggtaaaatatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaaaggggatgagaccgcgttcagtgtactggagggggttcatagctatactgtcagtctcagctttgaccatgctgtggtcgacgagcagtgccagctgaactgtggggggcatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctgctggggggattagccctcttcttcttaatcatgtctttgttcaaactgggaacaaaacaggtatttcgatcaaggacgaagctggcttag

SEQ ID NO: 4752 - RNA, 3222 nt, synthetic construct
  misc_feature 1..3222: note = derived and/or modified CDS sequence (wt) from SFTSV(DS03/CHN/2013)__KR698333.1__GP
  source 1..3222: mol_type = other RNA
atgatgaaagtcatctggttctcctctctgatctacttagttattcaatgcagtggggattcgggcccaatcatatgtgcagggcccatccactcaaacaagagtgccaacataccccacctgcttggttactctgagaagatttgtcagatagatcgactgatacatgtttcgtcatggctgagaaaccattcacaatttcagggctacgtggggcagcgaggtggacgctctcaggtgagctactacccagctgaaaactcttactcaaggtggagtggacttctaagcccctgtgatgctgattggcttgggatgcttgttgtgaagaaggccaaagggtctgatatgatagttcctgggccttcatacaaggggaaagtcttttttgaacggccaacttttgatggatacgtaggctggggctgtggcagtgggaagtcaaggactgagtcaggagagctctgcagctcagactcagggaccagttcaggtcttctgccctcagatagggttctctggataggtgatgtcgcttgccagcctatgacacccatccctgaggagacatttctggagctgaagagttttagccagagtgaattcccagacatatgtaaaattgatggcattgtgttcaaccagtgtgagagagagagtctacctcagccctttgatgttgcatggatggatgttggccactctcataaaattatcatgagggagcacaagaccaaatgggtgcaagagagctcatctaaggattttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcctggggaagttgtcgtgtcatatggagggatgcgagtcagaccaaagtgttatggtttctccagaatgatggcaacactagaggtgaacccaccagagcagaggattggccaatgtactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggagaacagcaatacacgtcaaaggggcactggtggatggaactgaattcacatttgagggtagttgcatgttcccagatggttgtgacgcagtggactgcacattctgtcgtgagttcctaaaaaatcctcaatgctaccctgcaaagaaatggttgttcatcattattgtcatcctccttggatatgcaggcctcatgctgctcaccaatgtccttaaggcaatcggggtttggggatcatgggtcatagctccagtgaagctaatgtttgccatcataaagaaactgatgagatctgtgagctgcctgatgggaaaattgatggataggggaaggcaagtgatccatgaagaaataggggagaatagagagggcaaccaagatgatattaggatcgagatggcaagacccagaagggtaaggcattggatgtactcacctgtcatcctgactattctagcagttgggcttgctgagggctgcgatgagatggtccatgcagattctaagcttgtttcgtgcaagcaggggagcggaaatatgaaggaatgtgtcacaacagggagggcgctccttcctgcggtgaacccaggacaagaggcatgcctgcacttcacggcacctgggagtccggactcaaaatgtctcaaaattaaggttaagaggattaacctaaaatgtaagaagtcatcatcatattttgttcctgatgctcggtcaaggtgcacatctgtgaggagatgtcgctgggcaggggactgtcagtctgggtgcccctctcatttcacgtctaactccttttctgatgattgggcaggtaaaatggacagggctggcctaggattcagtgggtgctctgatggatgtggaggagcagcttgtggctgctttaatgcggccccttcatgcattttctggaggaaatgggtagagaatccacatgggatcatctggaaagtatctccctgtgctgcatgggtcccatcagcagtcatagagctaacaatgccctcaggggaagtgaggacattccaccccatgagcggcatcccaacacaagtcttcaagggtgtgagtgtgacttacttaggctctgatatggaggtgtctggcttgactgacctgtgtgagatagaagagctaaagtccaagaagctggcattagctccctgcaaccaggctggcatgggggttgtaggtaaggtcggagagatacagtgcagcagtgaggaaagtgcccgtaccataaaaaaagatgggtgtatatggaatgctgaccttgtgggcatagagctacgagtggatgatgctgtgtgctactctaagatcactagtgtggaggcagttgcaaactactctgccatacccaccactattggggggctgaggtttgagagaagccatgacagccagggcaaaatatctggtagccccctggacatcacagccataagagggtctttttcagttaattacagaggccttcgactgagcctctcagaaattactgccacttgcacaggggaggtgacaaatgtgagtgggtgttactcttgcatgacaggcgccaaagtctccatcaagctgcacagcagcaaaaatagcactgcccatgtgaggtgcaaaggggatgagactgcgttcagtgtcctggagggagttcatagctatactgttagtctcagctttgaccatgcagtggtcgatgagcagtgccagctgaactgtggggggcatgagagtcaagtgactctaaaaggcaacctcatcttcctggatgtcccaaaatttgtagatggcagctacatgcagacatatcatagttctgtacccacaggggcaaatatcccaagccctacagactggctgaatgccctgtttggcaatgggctgagtaggtggattctgggggtgataggggttctactggggggattggctctctttttcttaatcatgtctttgttcaaattgggaacaaaacaggtatttcgatcaaggacgaagctggcttag

SEQ ID NO: 4753 - RNA, 3222 nt, synthetic construct
  misc_feature 1..3222: note = derived and/or modified CDS sequence (wt) from SFTSV(DS04/CHN/2013)__KR698334.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgaacggccaacttttgatggatacgtgggctggggctgtggcagtgggaagtcaaggacagagtcaggtgagctctgcagctcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcccggggaagttgttgtgtcatatggagggatgcgtgtcaggccaaagtgttatggtttctccagaatgatggcaacactggaggtgaacccaccagagcaaagaattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccattctgggtcattagttgggaaagcagcaatacacgtcaaaggggctttggtggatggtacagaattcacatttgagggcagttgcatgttcccagatggttgtgacgcagtggactgcacattctgtcgtgagtttctaaaaaatcctcagtgctaccctgcaaagaaatggttgttcattattattgtcatcctccttggatatgcaggcctcatgctactcaccaatgtccttaaagcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggtaagacccagaagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgtaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccgccccatgagcggcatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgtaaactactctgccatacccaccactattggggggctgaggtttgagagaagccatgacagccagggtaaaatatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaaaggggatgagaccgcgttcagtgtactggagggggttcatagctacactgtcagtctcagctttgaccatgcagtggtcgacgagcagtgccagctgaactgtggggggcatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctactggggggattagccctcttcttcttaatcatgtctttgttcaaactgggaacaaaacaggtatttcgatcaaggacgaagctggcttag

SEQ ID NO: 4754 - RNA, 3222 nt, synthetic construct
  misc_feature 1..3222: note = derived and/or modified CDS sequence (wt) from SFTSV(DS05/CHN/2013)__KR698335.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgaacggccaacttttgatggatacgtgggctggggctgtggcagtgggaagtcaaggacagagtcaggtgagctctgcagctcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcccggggaagttgttgtgtcatatggagggatgcgtgtcaggccaaagtgtcatggtttctccagaatgatggcaacactggaggtgaacccaccagagcaaagaattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccattctgggtcattagttgggaaagcagcaatacacgtcaaaggggctttggtggatggtacagaattcacatttgagggcagttgcatgttcccagatggttgtgacgcagtggactgcacattctgtcgtgagtttctaaaaaatcctcagtgctaccctgctaagaaatggttgttcattattattgtcatcctccttggatatgcaggcctcatgctactcaccaatgtccttaaagcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggtaagacccagaagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgcaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccaccccatgagcggaatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgcaaactactctgccatacccaccactattggggggcttaggtttgagagaagccatgacagccagggtaaaatatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaaaggggatgagaccgcgttcagtgtactggagggggttcatagctatactgtcagtctcagctttgaccatgcagtggtcgacgagcagtgccagctgaactgtggggggcatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctactggggggattagccctcttcttcttaatcatgtctttgttcaaactgggaacaaaacaggtatttcgatcaaggacgaagctggcttag

SEQ ID NO: 4755 - RNA, 3222 nt, synthetic construct
  misc_feature 1..3222: note = derived and/or modified CDS sequence (wt) from SFTSV(HB154/China/2011)__JQ733560.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggccaaggagtctgacatgatagttcctgggccttcatacaaggggaaagtcttttttgaacgaccaacttttgatggatacgtaggctggggctgtggcagtgggaagtctaggactgagtcaggagagctctgcagttcagactcagggacaagttctggtcttctgccctcggatagggttctctggataggtgatgttgcttgtcaacctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggctgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatcaatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggagggcgcttcttcctgcggtgaacccaggacaagaggcatgtctgcacttcacagcacctgggagtccggactcaaaatgtctcaaaattaaggtcaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaatgcagacctcgtgggcatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgaaagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctcttttccttgatcatgtttttgctcaagctgggaacaaaacaggtatttcgatcgaggacgaagctggcttag

SEQ ID NO: 4756 - RNA, 3222 nt, synthetic construct
  misc_feature 1..3222: note = derived and/or modified CDS sequence (wt) from SFTSV(HB155/China/2011)__JQ733563.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtgggcgctctcaggttagctactacccagctgagaattcttactcgaggtggagtggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtgcaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaaccctccagagcaaaggattggtcaatgcactggctgccatctagaatgcataaatgggggtgtgaggctaatcactctaaccagtgagctcaggtcagctactgtctgtgcttcccacttttgcagttctgccacaagtggtaagaaaagcacggagattcatttccactcaggatcattggttgggaaaacagccatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaaccgggagggcgcttcttcctgcggtgaacccagggcaagaggcatgtctgcacttcacagcacctgggagtccggactcaaaatgtctcaaaattaaggtcaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggtggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaatgcagacctcgtgggtatagagctacgagtggatgacgctgtgtgctactctaagattactagtgtggaggcagttgcaaactactctgccataccaaccactattggggggctgaggtttgagagaagccatgacagccagggtaaaatatctggtagccccctggacatcacagctataagaggatcattttctgttaattatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaagatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4757 - RNA, 3222 nt, synthetic construct
  misc_feature 1..3222: note = derived and/or modified CDS sequence (wt) from SFTSV(HB156/China/2011)__JQ733566.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggccaaggagtctgacatgatagttcctgggccttcatacaaggggaaagtcttttttgaacgaccaacttttgatggatacgtaggctggggctgtggcagtgggaagtctaggactgagtcaggagagctctgcagttcagactcagggacaagttctggtcttctgccctcggatagggttctctggataggtgatgttgcttgtcaacctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggctgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggagggcgctccttcctgcggtgaacccaggacaagaggcatgtctgcacttcacagcacctgggagtccggactcaaaatgtctcaaaattaaggtcaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgctgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtgggcaaggttggagagatacagtgcagtagcgaggagagtgcccgtaccataaaaaaagatgggtgcatatggaatgcagacctcgtgggcatagagctacgagtggatgacgctgtgtgctactctaagattactagtgtggaggcagttgcaaactactctgccatacccaccactattggggggctgaggtttgagagaatccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4758 - RNA, 3222 nt, synthetic construct
  misc_feature 1..3222: note = derived and/or modified CDS sequence (wt) from SFTSV(HB2014-04)__KR080475.1__GP
  source 1..3222: mol_type = other RNA
atgatgaaagtcatctggttcccctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcatgtgagctactacccagctgaaaattcttactcaaggtggagtgggcttctaagcccctgtgatgctgattggcttgggatgcttgtcgtgaagaaggccaaggggtctgatatgatagtccctgggccttcatacaagggaaaagtcttttttgagaggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctaaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgctccttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacttatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaattacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggtcgaagctggcttag

SEQ ID NO: 4759 - RNA, 3222 nt, synthetic construct
  misc_feature 1..3222: note = derived and/or modified CDS sequence (wt) from SFTSV(HNXH)__KT254590.1__GP
  source 1..3222: mol_type = other RNA
atgatgaaagtcatctggttctcctctctgatctgcttagtcattcaatgcggtggggatacgggcccaatcatctgcgcaggacccatccactcaaacaagagtgctgacataccccacctgcttggctactctgagaagatttgtcagatagatcggctgatacatgtttcgtcttggcttagaaaccactcacaatttcagggctacgtagggcagcgaggcggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactcggggactagttctggtcttctgccctcggatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatccgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctaatcactctaaccagtgagctcaagtcagctactgtctgcgcttctcacttttgcagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctgctcaccaatgttcttaaggcaattggggtttgggggtcatgggtcatagctccagtgaagctagtgtttgccctcataaagaaactgatgagagctgtgagctgcctgatggggaaattgatggataggggaaggcaagtgatccatgaggaaataggggaaaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaagggagcggaaatatgaaggaatgtgttacaactgggagggcgcttcttcctgcggtgaacccagggcaagaggcgtgtctgcacttcacggcacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctagggttcagtggctgctctgatggatgtggaggagcagcctgcggttgctttaatgcggccccttcatgcattttctggaggaaatgggtagagaatccacatgggatcatctggaaagtatccccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctagtgggtatagagctacgggtggatgacgctgtgtgctactctaagatcactagtgtggaggcagttgcaaactactccgccatacccaccactattggggggctgaggtttgagagaagccatgacagccagggtaaaatatctggtagccccctggacatcacagctataagaggatctttttctgtcaattatagaggccttcgactgagtctctcagaaatcactgccacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggagcaaatatccctagccctacagattggctaaatgccttgtttggcaatgggctgagtaggtggattctgggggtgacaggggtcctactggggggattggctctctttttcttgatcatgtctttgtttaagctgggaacaaaacagatatttcgatcgaggacaaagctggcttag

SEQ ID NO: 4760 - RNA, 3222 nt, synthetic construct
  misc_feature 1..3222: note = derived and/or modified CDS sequence (wt) from SFTSV(JS2012-goat01)__KC473538.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagctttagccaaagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtacacaagcccggagaagtcgttgtgtcatatggagggatgcgtatcagaccaaagtgctatggtttctccagaatgatggcaacactggaggtgaaccaaccagagcaaaggcttggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaaaaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactgtgagctgcttgatgaggaaattgatggatagggggaggcaagtgatccatgaggagataggggagaatagagagggcaaccaagatgatgttaggattgagatggcaagacccagaagggtaaggcattggatgtactcacctgtcatcctaactattttagcaatagggcttgctgagagctgcgatgagatggtccatgctgattctaagcttgtttcatgcaggcaagggagcggaaacatgaaggaatgtgtcacaactgggagggcgcttcttcctgcggtgaacccaggtcaagaggcatgtctgcacttcacggcacctgggagtccggactcaaaatgcctcaaaataaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaacgcagccccttcatgcatcttctggaggaaatgggtagaaaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgctgaccttgtgggcatagagctacgagtagatgacgctgtgtgctactctaagatcactagtgtggaagcagttgcaaactactctgccatacccaccactattggggggctgaggtttgagagaagccttgacagccagggtaaaatatctggtagccccctagacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagactgcattcagtgtcttggagggagtccatagctacactgtcagtctcagttttgaccatgcagtagtcgatgagcagtgccaactgaactgtggggggcatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagcaggtggatcctgggggtgataggggttctgcttggggggttggctctcttttttatgattatgtctttgttcaagctgggaacaaaacaggtatttcgatcaaggacaaagctggcttag

SEQ ID NO: 4761 - RNA, 3222 nt, synthetic construct
  misc_feature 1..3222: note = derived and/or modified CDS sequence (wt) from SFTSV(JS2012-tick01)__KC473541.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcggatagggttctctggataggtgatgttgcttgtcagcctatgacacccatccctgaagagacatttctggagctgaagagctttagccaaagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtacacaagcccggagaagtcgttgtgtcatatggagggatgcgtgtcagaccaaagtgctatggtttctccagaatgatggcaacactggaggtgaaccaaccagagcaaaggcttggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaaaaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactgtgagctgcttgatgaggaaattgatggatagggggaggcaagtgatccatgaggagataggggagaatagagagggcaaccaagatgatgttaggattgagatggcaagacccagaagggtaaggcattggatgtactcacctgtcatcctaactattttagcaatagggcttgctgagagctgcgatgagatggtccatgctgattctaagcttgtttcatgcaggcaagggagcggaaacatgaaggaatgtgtcacaactgggagggcgcttcttcctgcggtgaacccaggtcaagaggcatgtctgcacttcacggcacctgggagtccggactcaaaatgcctcaaaataaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaacgcagccccttcatgcatcttctggaggaaatgggtagaaaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgctactctaagatcactagtgtggaagcagttgcaaactactctgccatacccaccactattggggggctgaggtttgagagaagccatgacagccagggtaaaatatctggtagccccctagacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagactgcattcagtgtcttggagggagtccatagctacactgtcagtctcagttttgaccatgcagtagtcgatgagcagtgccaactgaactgtggggggcatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagcaggtggatcctgggggtgataggggttctgcttggggggttggctctcttttttatgattatgtctttgttcaagctgggaacaaaacaggtatttcgatcaaggacaaagctggcttag

SEQ ID NO: 4762 - RNA, 3222 nt, synthetic construct
  misc_feature 1..3222: note = derived and/or modified CDS sequence (wt) from SFTSV(LN2012-14)__KF887436.1__GP
  source 1..3222: mol_type = other RNA
atgatgaaagtcatctggttctcctctctgatctgctttgtcattcaatgcagtggggattcaggcccaatcatctgcgcaggacccatccactcaaacaagagtgctgacatacctcacctgctgggttattctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagtccccgggccttcatacaagggaaaagtcttttttgagcggccaacttttgatggatatgtaggctggggctgtggcagtgggaagtctaggacagagtcaggagagctctgcagttcagactcagggactagctctggtcttctgccctcggatagggttctctggataggtgatgttgcttgtcagccaatgacacccatccctgaggagacatttctggagctgaagagttttagccaaagtgaatttccagacatatgcaaaattgatggcattgtgttcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggagacatgcagttctgcaaggtggcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtggatggaactgaattcacatttgagggtagttgcatgttcccagatggttgtgatgcggtggactgcactttctgtcgtgagtttctaaaaaatccccagtgctaccctgctaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgtttggatcgagatggcaagacccagaagggtaaggtattggatgtactcacctgtcatcctgactattttggcagtagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcgtgtctgcacttcacggcacctgggagtccggactcaaaatgtctcaaaattagggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggtaggtaagatggacagggctggtctaggattcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtaacttacttgggctcagatatggaggtgtctggcttgactgacctatgtgagatagaggagctcaagtccaagaagctggcattagctccctgcaaccaggctggcatgggggttgtgggcaaggttggagagatacagtgcagtagcgaggaaagtgcccgtaccataaaaaaagatgggtgcatatggaatgcagacctcgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagccataagaggatctttttctgttaattatagaggccttcgactgagtctctcagaaattactgctacctgcacaggggaggtgacaaatgtgagtgggtgttattcttgcatgacaggcgccaaagtctctatcaaactgcatagcaacaaaaatagcactgcccatgtaagatgcaaaggggatgagactgcattcagtgttttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcacagcactgtgcccacaggggcaaatatcccaagccctacagactggctgaatgccttgtttggcaatgggctgagtaggtggatcctgggggtgataggggttctgcttgggggattggctctctttttcatgatcatgtctttgttcaagttgggaacaaaacaggtatttcgatcaaggacgaagctggcttag

SEQ ID NO: 4763 - RNA, 3222 nt, synthetic construct
  misc_feature 1..3222: note = derived and/or modified CDS sequence (wt) from SFTSV(LN2012-34)__KF887437.1__GP
  source 1..3222: mol_type = other RNA
atgatgaaagtcatctggttcttctctctgatctgctttgtcattcaatgcagtggggattcaggcccaatcatctgcgcaggacccatccactcaaacaagagtgctgacatacctcacctgctgggttattctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctgagcccctgtgatgctgattggcttgggatgcttgtcgtgaagaaggccaaggggtctgatatgatagtccctgggccttcatacaagggaaaagtcttttttgaacggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgtaggggagacatgcagttctgcaaggtggcaggttgtgaacatggggaagaggcatctgaagccaagtgcagatgctcacttgtgcacaagcccggagaagtcgttgtgtcatatggagggatgcgtatcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacatgtcaaaggggcattggtggatggaactgaattcacatttgagggtagttgcatgttcccagatggttgtgatgcggtggactgcactttctgtcgtgagtttctaaaaaatccccagtgctaccctgctaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggatcgagatggcaagacccagaagggtaaggcattggatgtactcacctgtcatcctgaccattttagcaatagggcttgctgagagctgtgatgagatggtccatgctgattctaagcttgtttcatgcaggcaagggagcggaaatgtgaaggaatgtgtcacaactgggagggcgcttcttcctgcggtgaacccaggtcaagaggcgtgtctgcacttcacggcacctgggagtccggactcaaaatgtctcaaaattagggttaagaggatcaacctaaaatgtaagaagtcatcatcatattttgtccctgatgcccggtccagatgtacatcagtgaggagatgtcgttgggctggagactgccagtctgggtgcccccctcatttcacatccaattccttttctgatgattgggcaggtaagatggacagggctggtctaggattcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgagaacattccaccccatgagtggcatccccacacaagtcttcaagggtgtgagcataacttacttgggctcagatatggaggtgtctggcttgactgacctatgtgagatagaggagctcaagtctaagaagctggcattagctccctgcaaccaggctggcatgggggttgtaggcaaggttggagagatacagtgcagtagcgaggaaagtgcccgtaccataaaaaaagatgggtgcatatggaatgcagacctcgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagccataagagggtctttttctgttaattatagaggccttcgactgagtctctcagaaattactgcaacctgcacaggggaggtgacaaatgtgagtgggtgttattcttgcatgacaggcgccaaagtctctatcaaactgcatagcaacaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcacagcactgtgcccacaggggcaaatatcccaagccctacagactggctgaatgccttgtttggcaatgggctgagtaggtggatcctgggggtgataggggttctgcttgggggattggctctctttttcatgatcatgtctttgttcaagctgggaacaaaacaggtatttcgatcaaggacgaagctggcttag

SEQ ID NO: 4764 - RNA, 3222 nt, synthetic construct
  misc_feature 1..3222: note = derived and/or modified CDS sequence (wt) from SFTSV(LN2012-41)__KF887438.1__GP
  source 1..3222: mol_type = other RNA
atgatgaaagtcatctggttctcctctctgatctgctttgtcattcaatgcagtggggattcaggcccaatcatctgcgcaggacccatccactcaaacaagagtgctgacatacctcacctgctgggttattctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctgagcccctgtgatgctgattggcttgggatgcttgtcgtgaagaaggccaaggggtctgatatgatagtccctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcggatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgtaggggagacatgcagttctgcaaggtggcaggttgtgaacatggggaagaggcatctgaagccaagtgcagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtggatggaactgaattcacatttgagggtagttgcatgttcccagatggttgtgatgcggtggactgcactttctgtcgtgagtttctaaaaaatccccagtgctaccctgctaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggatcgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatgtgaaggaatgtgtcacaactgggagggcgcttcttcctgcggtgaacccaggtcaagaggcgtgtctgcacttcacggcacctgggagtccggactcaaaatgtctcaaaattagggttaagaggatcaacctaaaatgtaagaagtcatcatcatattttgttcctgatgcccggtccagatgtacatcagtgaggagatgtcgttgggctggagactgccagtctgggtgcccccctcatttcacatccaattccttttctgatgattgggcaggtaagatggacagggctggtctaggattcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgagaacattccaccccatgagtggcatccccacacaagtcttcaagggtgtgagtgtaacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagacctcgtgggcatagagctacgagtggatgacgctgtgtgctactctaagatcactagtgtggaagcagttgtaaactactctgccatacccaccactattggggggctgaggtttgagagaagccatgacagccagggtaaaatatctggtagccccctggacatcacagccataagaggatctttttctgttaattatagaggccttcgactgagtctctcagaaattactgcaacctgcacaggggaggtgacaaatgtgagtgggtgttattcttgcatgacaggcgccaaagtctctatcaaactgcatagcaacaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcacagcactgtgcccacaggggcaaatatcccaagccctacagactggctgaatgccttgtttggcaatgggctgagtaggtggatcctgggggtgataggggttctgcttgggggattggctctctttttcatgatcatgtctttgttcaagctgggaacaaaacaggtatttcgatcaaggacaaagctggcttag

SEQ ID NO: 4765 - RNA, 3222 nt, synthetic construct
  misc_feature 1..3222: note = derived and/or modified CDS sequence (wt) from SFTSV(LN2012-58)__KF887440.1__GP
  source 1..3222: mol_type = other RNA
atgatgaaagtcatctggttctcctctctgatctgctttgtcattcaatgcagtggggactcgggcccaatcatctgcgcaggacccatccattcaaataagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagattcagggactagctctggtcttctgccctctgatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaagtgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgttcacaagcccggagaagttgttgtgtcatatggagggatgcgtgtcaggccaaagtgctatggtttctccagaatgatggcaacactggaggtgaaccaaccagtgcaaaggattggtcaatgcactggctgccatctggaatgcataaatgggggtgtgaggctaataactctaaccagtgagctcaagtcagctactgtctgtgcttcccacttttgtagttctgccacgagtggcaagaaaagcacggagatacaattccactcaggatcattggttgggaaaacagcaatacacgtcaaaggggcattggtagatggaactgaattcacatttgagggtagctgcatgttcccggatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattggaatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagtaatggggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccagactcaaaatgtctcaaaattaaggttaagaggatcaacctaaaatgcaagaagtcatcatcatattttgttcctgatgcccggtccagatgtacatcagtgaggagatgtcgttgggctggagactgccagtcagggtgcccccctcatttcacatccaactccttttctgatgattgggcaggcaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccctacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgatgctgtgtgctactctaagatcactagtgtggaagcagttgcaaactactctgccatacccaccactattggggggctgaggtttgagagaagccatgacagccagggtaaaatatctggtagccctctggacatcacagctataagaggatctttttcagttaattatagaggccttcgactgagcctctcagaaattactgctacctgcacaggggaggtgacaaatgtgagcggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctgcttgggggattggctctctttttcatgatcatgtctttgttcaagctgggaacaaaacaggtatttcgatcaaggacgaagctggcttag

SEQ ID NO: 4766 - RNA, 3222 nt, synthetic construct
  misc_feature 1..3222: note = derived and/or modified CDS sequence (wt) from SFTSV(NB24/CHN/2013)__KR698337.1__GP
  source 1..3222: mol_type = other RNA
atgatgaaagtcatctggttctcctctctgatctgcttagtcattcaatgcagtggggacacgggcccaatcatatgcgcaggacccatccactcaaacaagagtgccgacataccccacctgcttggttactctgagaagatttgtcagatagatcggctgatacatgtttcgtcatggctgagaaaccattcacaatttcagggctacgtggggcagcgaggtgggcgctcacaggtaagctactacccagctgaaaactcttactcaaggtggagtggacttctaagcccctgtgatgctgattggcttgggatgcttgttgtgaagaaggccaaagggtctgatatgatagttcctgggccttcatacaaggggaaagtcttttttgaacggccaacttttgatggatacgtaggctggggctgtggcagtgggaagtcaaggactgagtcaggagagctctgcagctcagactcagggaccagttcaggtcttctgccctcagatagggttctctggataggtgatgttgcttgccagcctatgacacccatccctgaagagacattcctggagctgaagagttttagccagagtgaattcccagacatatgtaaaattgatggcattgtgtttaaccagtgtgagagtgagagtctacctcaaccctttgatgttgcatggatggatgtaggccactctcataaaatcatcatgagggagcacaagaccaaatgggtgcaagagagctcttctaaggattttgtgtgctacaaggaagggactgggccgtgttctgaatcagaagaaaagacttgcaagaccagtgggtcatgcaggggggacatgcagttttgcaaggtggcaggttgtgagcatggggaagaggcatctgaagccaagtgtagatgctcactagtgcacaagccaggggaagttgttgtgtcatatggagggatgcgtgtcaggccaaagtgttatggtttctccagaatgatggcaacactagaggtgaacccaccagagcaaaggattggccaatgcactggctgccatctagagtgtgtaaatgggggtgtgaggctaatcactctaactagtgagctcaagtcagctactgtctgtgcttcccacttttgtagttctgccacaagtggcaagaaaagcacagagattcaattccactcagggtcattagttgggaaaacagcaatacacgtcaaaggggctttggtggatggaactgaattcacatttgagggcagttgcatgttcccagatggttgtgacgcagtggactgcacgttctgtcgtgagtttctaaaaaatcctcagtgttaccctgcaaagaaatggttgttcatcaatattgtcatcctccttggatatgcaggcctcatgctactcaccaatgtccttaaggcaatcggggtttggggatcatgggtcatagctccagtgaagctaatgtttgccatcataaagaaactgatgagatctgtgagctgcttgatggggaaattaatggataggggaaggcaagtgatccatgaggaaataggggagaatagagagggcaaccaagatgatgttaggatcgagatggcaagacccagaagggtaaggcattggatgtactcacctgtcatcctgactattctagcagttgggcttgctgagggctgcgatgagatggtccatgcagattctaagcttgtttcgtgcaagcaagggagcggaaatatgaaggaatgtgtcacaactgggagggcgctccttcctgcggtgaacccagggcaagaggcatgtctgcacttcacggcacctgggagtccggactcaaaatgtctcaaaattaaggttaagaagattaatctaaaatgtaagaagtcatcatcatattttgtccctgatgctcggtctaggtgtacatctgtgaggagatgtcgctgggcaggagactgccagtctgggtgcccctctcatttcacatccaactccttttctgatgattgggcaggtaaaatggacagggctggtctaggattcagtgggtgctctgatggatgtggaggagcagcctgcggctgctttaatgcagccccttcatgcatcttttggaggaaatgggtagagaacccacatgggatcatctggaaagtatctccatgtgctgcatgggttccatcagcagtcatagagctaacaatgccctcaggggaagtgaggacattccaccctatgagcggcatccccacacaggttttcaagggtgtgagtgtgacttacttaggctcagatatggaggtgtctggcttgactgacctgtgtgagatagaagagctcaagtctaagaagctggcattagccccctgcaatcaggctggcatgggggttgtaggcaaggttggagagatacagtgcagtagcgaggaaagtgcccgcaccataaaaaaagatgggtgtatatggaatgctgaccttgtgggcatagaactacgagtggatgacgctgtgtgctactctaagatcactagtgtggaggcagttgcaaactactctgccatacccaccactattggggggctgaggtttgagagaagccatgacagccagggtaagatatctggtagccccctagacatcacagccataagagggtccttttcagttaattatagaggccttcgactaagcctctcagaaattactgcaacttgcacaggagaggtgacaaatgtgagtggttgttactcttgcatgacaggcgccaaagtctccatcaaactgcatagcaacaaaaatagcactgcccatgtaagatgcaaaggggatgagactgcgttcagcgtcctggagggagttcatagctatactgtcagtctcagctttgaccatgcagtggtcgatgagcagtgccagctgaactgtggggggcatgagagtcaagtgactctaaaaggcaacctcatctttctggatgtcccaaaatttgtggatggcagctatatgcagacatatcatagttctgtacccacaggggctaatatcccaagccctacagactggctgaatgccttgtttggcaatgggctgagtaggtggattctgggggtgataggggttctactggggggattggctctctttttcttaatcatgtctttgttcaaattgggaactaaacaggtatttcgatcaaggtcgaagctggcttag

SEQ ID NO: 4767 - RNA, 3222 nt, synthetic construct
  misc_feature 1..3222: note = derived and/or modified CDS sequence (wt) from SFTSV(NB31/CHN/2013)__KR698338.1__GP
  source 1..3222: mol_type = other RNA
atgatgaaagtcatctggttctcctctctgatctgctttgtcatccaatgcagtggggatacgggcccaatcatatgcgcaggacccatccactcaaacaagagtgccaacataccccacttgcttggttactctgagaagatttgtcagatagatcgactgatacatgtttcgtcatggctgagaaaccattcacaatttcagggctacgtagggcagcgaggtggacgctcccaggtaagttactacccatctgaaaactctaactctaggtggagtggacttctaagcccctgtgatgctgattggcttgggatgcttgttgtgaagaaggccaaagggtctgatatgatagttcccgggccttcatacaaggggaaagtcttttttgaacggccaacttttgatggatacgtaggctggggctgtggcagtgggaagtcacggactgagtcaggagagctctgcagttcagactcagggaccagttcaggtcttctgccctcagatagagttctctggataggtgatgttgcttgccagcctatgacacccatccctgaggagacatttctggagctgaagagttttagccagagtgaattcccagacatatgcaaaattgatggcattgtgttcaaccagtgtgagagtgagagtctacctcaaccctttgatgttgcatggatggatgtaggccactctcataaaatcatcatgagggagcacaagaccaaatgggtacaagagagctcttccaaggattttgtgtgctacaaggaagggactgggccgtgttctgaatcagaagaaaagacttgcaagaccagtggatcatgcaggggggacatgcagttttgcaaggtggcaggttgtgagcatggggaagaggcatctgaggccaagtgtagatgctcactagtgcacaagcccggggaagttgttgtgtcatatggagggatgcgtgtcagaccaaagtgttatggtttctccagaatgatggctacactggaggtgaacccaccagagcaaaggattggccaatgcactggctgccatctagaatgtataaatgggggtgtgaggctaatcactctaactagtgagctcaagtcagctactgtctgtgcttcccacttttgtagttctgccacaagtggcaagaaaaatacggagattcaattccactcagggtcattagttgggaaaacagtaatacacgtcaaaggggctttggtggatggaactgaattcacatttgagggcagttgcatgttcccagatggttgtgaagcagtggactgtacattctgtcgtgagtttctaaaaaatccacagtgctaccctgcaaagaaatggttgttcatcattattgtcatcctccttggatatgcaggcctcatgctactcaccaatgtccttaaggcaatcggagtttggggatcatgggtcatagctccagtgaagctaatgtttgccatcataaagaaactgatgagatctgtgagctgcttgatggggaaattaatggataggggaaggcaagtgatccatgaagaaataggggagaatagagagggcaaccgagatgatgttaggatcgagatggcaagacctagaagggtaaggcattggatgtactcacctgtcatcctgactattctagcaattgggcttgctgagggctgcgatgagatggtccatgcagattctaaacttgtttcgtgcaagcaagggagcggaaatatgaaggaatgtgtcacaactgggagggtgctccttcctgcggtgaacccaggacaagaggcatgcctgcacttcacggcacctgggagtccggactcaaaatgtctcaaaattaaggttaagaggattaacctaaaatgtaagaagtcatcatcatattttgtccctgatgctcggtccaggtgtacatctgtgaggagatgtcgctgggcaggagactgccagtctggctgcccctctcatttcacgtccaactccttttctgatgattgggcaggtaaaatggacagggctggtctaggattcagtgggtgctctgatggatgtggaggagcagcctgcggctgctttaatgcggccccttcatgcatcttttggaggaaatgggtagagaacccacatgggatcatctggaaagtatctccatgtgctgcatgggtcccatcagcagtcatagaactaacaatgccctcaggggaagtgaggacattccaccccatgagcggcatccctacacaagtctttaagggtgtgagtgtgacttacttaggctcagatatggaggtgtctggcttgactgacctgtgtgagatagaagagctcaagtccaagaagctggcattagccccctgcaatcaggctggcatgggggttgtaggcaaggttggagagatacagtgcagtagcgaggaaagtgcccgcaccataaaaaaagatgggtgtatatggaatgctgaccttgtgggcatagagctacgagtggatgacgctgtgtgctactctaagatcactagtgtggaggcagttgcaaactactctgccatacccaccactattggggggctgaggtttgagagaagccatgacagccagggcaagatatctggtagccccctagacatcacagccataagagggtctttttcagttaattatagaggccttcgactgagcctttctgaaattactgctacttgcacaggagaggtgacgaatgtgagtgggtgttactcttgcatgactggcgccaaagtctccattaaactgcatagcagcaaaaatagcactgcccatgtaagatgcaaaggggatgagactgcgttcagtgtcctggagggagttcatagctatactgtcagtctcagctttgatcatgcagtggtcgatgagcagtgccagctgaactgtggggggcatgagagtcaagtgactctaaaaggcaacctcatcttcctggatgtcccaaaatttgtggatggcagctatatgcagacatatcacagttctgtacccacaggggctaatatcccaagccctacagactggctgaatgccttgtttggcaatgggctgagtaggtggattctgggggtggtaggggttctactggggggattggttctctttttcttaatcatgtctttgttcaaattgggaacaaaacaggtatttcgatcaaggacgaagctggcttag

SEQ ID NO: 4768 - RNA, 3222 nt, synthetic construct
  misc_feature 1..3222: note = derived and/or modified CDS sequence (wt) from SFTSV(NB38/CHN/2013)__KR698341.1__GP
  source 1..3222: mol_type = other RNA
atgatgaaagtcatctggttctcctctctgatctgcttagtcattcaatgcggtggggatacgagcccaatcatctgcgcaggacccatccactcaaacaagagtgctgacataccccacctgcttggctactctgagaagatttgtcagatagatcggctgatacatgtttcgtcatggcttagaaaccactcacaatttcagggctacgtagggcagcgaggtggacgctctcaggtgagctactacccagctgaaaattcttactcaaggtggagtggacttctaagcccctgtgatgctgattggcttgggatgcttgttgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactctgggactagttctggtcttctgccctcggatagggttctctggataggtgatgttgcttgtcagcctatgacacccatccctgaggagacatttctggagctgaagagctttagccaaagtgaattcccagacatatgcaaaattgatggcattgtgttcaaccagtgtgagggtgagagtctacctcagccctttgatgttgcgtggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatgaggaagaggcatctgaagccaagtgtagatgctcacttgtgcacaagcccggagaagtcgttgtgtcatatggagggatgcgtgtaagaccaaagtgctatggtttctccagaatgatggcaacactggaggtgaaccaaccagagcaaaggattggtcaatgcactggctgccatctagaatgcataagtgggggtgtgaggctgatcactctaaccagtgagctcaagtcagctactgtctgcgcttctcacttttgtagttctgccacaagtggtaagaaaagcacggagattcaattccactcaggatcattggttgggaaaacagcaatccacgtcaaaggggcactggtagatggaactgaattcacatttgagggtagttgcatgtttccagatggttgtgatgcagtggactgcacattctgtcgtgagtttctaaaaaatcctcagtgctaccctgcaaagaagtggctgttcatcattattgtcatcctccttggatatgcaggcctcatgctactcaccaatgttcttaaggcaataggggtttgggggtcatgggtcatagctccagtgaagctagtgtttgccatcataaagaagctaatgagagctgtgagctgcctgatggggaaattgatggataggggaaggcaagtgatccatgaggaaataggggagaatagagagggcaaccaagatgatgttaggatcgagatggccagacccaggagggtaaggcattggatgtactcgcctgtcatcctgactattctagcaatagggcttgctgagggctgtgatgaaatggtccatgctgattcaaaacttgtttcgtgcaggcaagggagcggaaatatgaaggaatgtgtcacaactgggagggcgcttcttcctgcggtgaacccagggcaagaggcgtgtctgcactttacggcacctggaagtccagactcaaaatgtctcaaaattaaggttaagaggatcaacctaaaatgtaagaagtcatcatcatattttgttcctgatgcccggtccaggtgtacatcagtgaggagatgtcgttgggcaggagactgccagtctgggtgcccccctcatttcacatctaactccttttctgatgattgggcaggtaagatggacagggctggtctaggattcagtggctgctctgatggatgtggaggagcagcctgcggttgctttaatgcggccccttcatgcattttctggaggaaatgggtagagaatccccatgggatcatctggaaagtatctccatgtgccgcatgggtcccatcagcagtcatagagctaacaatgccctcaggggaggtgaggacattccaccccatgagcggaatccccacacaagtctttaagggtgtgagtgtaacttacttgggctctgatatggaggtgtcaggcttgactgacctgtgtgagatggaagagctcaagtcaaaaaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggtatagagctacgagtggatgacgctgtgtgctactctaagatcactagtgtggaggcagttgcaaaccactccgccatacccaccactattggggggctgaggtttgagagaagccatgacagccagggtaaaatatctggtagccccctggacatcacagctataagaggatctttttctgtcaattacagaggccttcgactgagtctctcagaaattactgctacttgtacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtaaagtgactctaagaggcaacctcatcttcctggatgtcccgaaatttgtggatggcagctacatgcagacatatcatagtacagtgcccacaggggcaaatatcccaagccctacagattggctaaatgccttgtttggcaatgggctgagtaggtggtttctgggagtaataggggtcctactggggggattggctctctttttcttgatcatgtctttgttcaagctgggaacaaaacaagtatttcgatcgaggtcgaagctggcttag

SEQ ID NO: 4769 - RNA, 3222 nt, synthetic construct
  misc_feature 1..3222: note = derived and/or modified CDS sequence (wt) from SFTSV(NB39/CHN/2014)__KR698342.1__GP
  source 1..3222: mol_type = other RNA
atgatgaaagttatctggttctcctctctgatctgcttagtcattcaatgcagtggggacacgggcccaatcatatgcgcaggacccatccactcaaacaagagtgccgacataccccacctgcttggttactctgagaagatttgtcagatagatcggctgatacatgtttcgtcatggctgagaaaccattcacaatttcagggctacgtggggcggcgaggtgggcgctcacaggtaagctactacccagctgaaaactcttactcaaggtggagtggacttctaagcccctgtgatgctgattggcttgggatgcttgttgtgaagaaggccaaagggtctgatatgatagttcctgggccttcatacaaggggaaagtcttttttgaacggccaacttttgatggatacgtaggctggggctgtggcagtgggaagtcaaggactgagtcaggagagctctgcagctcagactcagggaccagttcaggtcttctgccctcagatagggttctctggataggtgatgttgcttgccagcctatgacacccatccctgaagagacattcctggagctgaagagttttagccagagtgaattcccagacatatgtaaaattgatggcattgtgtttaaccagtgtgagagtgagagtctacctcaaccctttgatgttgcatggatggatgtaggccactctcataaaatcatcatgagggagcacaagaccaaatgggtgcaagagagctcttctaaggattttgtgtgctacaaggaagggactgggccgtgttctgaatcagaagaaaagacttgcaagaccagtgggtcatgcaggggggacatgcagttttgcaaggtggcaggttgtgagcatggggaagaggcatctgaagccaagtgtagatgctcactagtgcacaagccaggggaagttgttgtgtcatatggagggatgcgtgtcaggccaaagtgttatggtttctccagaatgatggcaacactagaggtgaacccaccagagcaaaggattggccaatgcactggctgccatctagagtgtgtaaatgggggtgtgaggctaatcactctaactagtgagctcaagtcagctactgtctgtgcttcccacttttgtagttctgccacaagtggcaagaaaagcacagagattcaattccactcagggtcattagttgggaaaacagcaatacacgtcaaaggggctttggtggatggaactgaattcacatttgagggcagttgcatgttcccagatggttgtgacgcagtggactgcacgttctgtcgtgagtttctaaaaaatcctcagtgttaccctgcaaagaaatggttgttcatcattattgtcatcctccttggatatgcaggcctcatgctactcaccaatgtccttaaggcaatcggggtttggggatcatgggtcatagctccagtgaagctaatgtttgccatcataaagaaactgatgagatctgtgagctgcttgatggggaaattaatggataggggaaggcaagtgatccatgaggaaataggggagaatagagagggcaaccaagatgatgttaggatcgagatggcaagacccagaagggtaaggcattggatgtactcacctgtcatcctgactattctagcagttgggcttgctgagggctgcgatgagatggtccatgcagattctaagcttgtttcgtgcaagcaagggagcggaaatatgaaggaatgtgtcacaactgggagggcgctccttcctgcggtgaacccagggcaagaggcatgtctgcacttcacggcacctgggagtccggacttaaaatgtctcaaaattaaggttaagaagattaatctaaaatgtaagaagtcatcatcatattttgtccctgatgctcggtctaggtgtacatctgtgaggagatgtcgctgggcaggagactgccagtctgggtgcccctctcatttcacatccaactccttttctgatgattgggcaggtaaaatggacagggctggtctaggattcagtgggtgctctgatggatgtggaggagcagcctgcggctgctttaatgcagccccttcatgcatcttttggaggaaatgggtagagaacccacatgggatcatctggaaagtatctccatgtgctgcatgggttccatcagcagtcatagagctaacaatgccctcaggggaagtgaggacattccaccctatgagcggcatccccacacaggttttcaagggtgtgagtgtgacttacttaggctcagatatggaggtgtctggcttgactgacctgtgtgagatagaagagctcaagtctaagaagctggcattagccccctgcaatcaggctggcatgggggttgtaggcaaggttggagagatacagtgcagtagcgaggaaagtgcccgcaccataaaaaaagatgggtgtatatggaatgctgaccttgtgggcatagaactacgagtggacgacgctgtgtgctactctaagatcactagtgtggaggcagttgcaaactactctgccatacccaccactattggggggctgaggtttgagagaagccatgacagccagggtaagatatctggtagccccctagacatcacagccataagagggtccttttcagttaattatagaggccttcgactaagcctctcagaaattactgcaacttgcacaggagaggtgacaaatgtgagtggttgttactcttgcatgacaggcgccaaagtctccatcaaactgcatagcaacaaaaatagcactgcccatgtaagatgcaaaggggatgagactgcgttcagcgtcctggagggagttcatagctatactgtcagtctcagctttgaccatgcagtggtcgatgagcagtgccagctgaactgtggggggcatgagagtcaagtgactctaaaaggcaacctcatctttctggatgtcccaaaatttgtagatggcagctatatgcagacatatcatagttctgtacccacaggggctaatatcccaagccctacagactggctgaatgccttgtttggcaatgggctgagtaggtggattctgggggtgataggggttctactggggggattggctctctttttcttaatcatgtctttgttcaaattgggaactaaacaggtatttcgatcaaggacgaagctggcttag

SEQ ID NO: 4770 - RNA, 3222 nt, synthetic construct
  misc_feature 1..3222: note = derived and/or modified CDS sequence (wt) from SFTSV(QD7)__KR706566.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgtcgcttgtcagcctatgacacccatccctgaagagacatttctggagctgaagagttttagccaaagtgaattcccagacatatgcaaaattgatggcattgtgttcaaccagtgtgaaggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtacacaagcccggagaagtcgttgtgtcatatggagggatgcgtatcagaccaaagtgctatggtttctccagaatgatggcgacactggaggtgaaccaaccagagcaaaggattggccaatgcactggctgccatctggaatgcataaatgggggtgtgaggctaataaccctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcagtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactatgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctaacttttttagcaatagggcttgctgagagctgcgatgagatggtccatgctgattctaagcttgcttcatgcaggcaaggtagcggaaatatgaaggaatgtgtcacaactgggagggcgcttcatcctgcggtgaacccaggtcaagaggcatgtctgcacttcacggcgcctgggagtccggactcaaaatgtctcaaaattaaggttaagaggatcaacctaaaatgtaagaagtcatcatcatattttgttcctgatgcccggtccagatgtacatcagtgaggagatgtcgctgggctggagactgccagtctgggtgccccccccatttcacatccaactccttttctgatgattgggcaggtaagatggacagggctggtctagggttcagtggctgctctgatggatgtggaggagcagcctgcggctgctttaatgcagctccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtatctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattacagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagacagcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggtagctacatgcagacatatcatagcactgtgcccacaggggcaaatatcccaagcccaacagactggctgaatgccttgtttggcaatgggctgagcaggtggatcctgggggtgataggggttctgcttggggggttggctctctttttcatgattatgtctttgttcaagctgggaacaaaacaggtatttcgatcaaggacaaagctggcttag

SEQ ID NO: 4771 - RNA, 3222 nt, synthetic construct
  misc_feature 1..3222: note = derived and/or modified CDS sequence (wt) from SFTSV(Rodent01/NB/CHN/2014)__KR698343.1__GP
  source 1..3222: mol_type = other RNA
atgatgaaagttatctggttctcctctctgatctgcttagtcattcaatgcagtggggacacgggcccaatcatatgcgcaggacccatccactcaaacaagagtgccgacataccccacctgcttggttactctgagaagatttgtcagatagatcggctgatacatgtttcgtcatggctgagaaaccattcacaatttcagggctacgtggggcggcgaggtgggcgctcacaggtaagctactacccagctgaaaactcttactcaaggtggagtggacttctaagcccctgtgatgctgattggcttgggatgcttgttgtgaagaaggccaaagggtctgatatgatagttcctgggccttcatacaaggggaaagtcttttttgaacggccaacttttgatggatacgtaggctggggctgtggcagtgggaagtcaaggactgagtcaggagagctctgcagctcagactcagggaccagttcaggtcttctgccctcagatagggttctctggataggtgatgttgcttgccagcctatgacacccatccctgaagagacattcctggagctgaagagttttagccagagtgaattcccagacatatgtaaaattgatggcattgtgtttaaccagtgtgagagtgagagtctacctcaaccctttgatgttgcatggatggatgtaggccactctcataaaatcatcatgagggagcacaagaccaaatgggtgcaagagagctcttctaaggattttgtgtgctacaaggaagggactgggccgtgttctgaatcagaagaaaagacttgcaagaccagtgggtcatgcaggggggacatgcagttttgcaaggtggcaggttgtgagcatggggaagaggcatctgaagccaagtgtagatgctcactagtgcacaagccaggggaagttgttgtgtcatatggagggatgcgtgtcaggccaaagtgttatggtttctccagaatgatggcaacactagaggtgaacccaccagagcaaaggattggccaatgcactggctgccatctagagtgtgtaaatgggggtgtgaggctaatcactctaactagtgagctcaagtcagctactgtctgtgcttcccacttttgtagttctgccacaagtggcaagaaaagcacagagattcaattccactcagggtcattagttgggaaaacagcaatacacgtcaaaggggctttggtggatggaactgaattcacatttgagggcagttgcatgttcccagatggttgtgacgcagtggactgcacgttctgtcgtgagtttctaaaaaatcctcagtgttaccctgcaaagaaatggttgttcatcattattgtcatcctccttggatatgcaggcctcatgctactcaccaatgtccttaaggcaatcggggtttggggatcatgggtcatagctccagtgaagctaatgtttgccatcataaagaaactgatgagatctgtgagctgcttgatggggaaattaatggataggggaaggcaagtgatccatgaggaaataggggagaatagagagggcaaccaagatgatgttaggatcgagatggcaagacccagaagggtaaggcattggatgtactcacctgtcatcctgactattctagcagttgggcttgctgagggctgcgatgagatggtccatgcagattctaagcttgtttcgtgcaagcaagggagcggaaatatgaaggaatgtgtcacaactgggagggcgctccttcctgcggtgaacccagggcaagaggcatgtctgcacttcacggcacctgggagtccggacttaaaatgtctcaaaattaaggttaagaagattaatctaaaatgtaagaagtcatcatcatattttgtccctgatgctcggtctaggtgtacatctgtgaggagatgtcgctgggcaggagactgccagtctgggtgcccctctcatttcacatccaactccttttctgatgattgggcaggtaaaatggacagggctggtctaggattcagtgggtgctctgatggatgtggaggagcagcctgcggctgctttaatgcagccccttcatgcatcttttggaggaaatgggtagagaacccacatgggatcatctggaaagtatctccatgtgctgcatgggttccatcagcagtcatagagctaacaatgccctcaggggaagtgaggacattccaccctatgagcggcatccccacacaggttttcaagggtgtgagtgtgacttacttaggctcagatatggaggtgtctggcttgactgacctgtgtgagatagaagagctcaagtctaagaagctggcattagccccctgcaatcaggctggcatgggggttgtaggcaaggttggagagatacagtgcagtagcgaggaaagtgcccgcaccataaaaaaagatgggtgtatatggaatgctgaccttgtgggcatagaactacgagtggacgacgctgtgtgctactctaagatcactagtgtggaggcagttgcaaactactctgccatacccaccactattggggggctgaggtttgagagaagccatgacagccagggtaagatatctggtagccccctagacatcacagccataagagggtccttttcagttaattatagaggccttcgactaagcctctcagaaattactgcaacttgcacaggagaggtgacaaatgtgagtggttgttactcttgcatgataggcgccaaagtctccatcaaactgcatagcaacaaaaatagcactgcccatgtaagatgcaaaggggatgagactgcgttcagcgtcctggagggagttcatagctatactgtcagtctcagctttgaccatgcagtggtcgatgagcagtgccagctgaactgtggggggcatgagagtcaagtgactctaaaaggcaacctcatctttctggatgtcccaaaatttgtagatggcagctatatgcagacatatcatagttctgtacccacaggggctaatatcccaagccctacagactggctgaatgccttgtttggcaatgggctgagtaggtggattctgggggtgataggggttctactggggggattggctctctttttcttaatcatgtctttgttcaaattgggaactaaacaggtatttcgatcaaggacgaagctggcttag

SEQ ID NO: 4772 - RNA, 3222 nt, synthetic construct
  misc_feature 1..3222: note = derived and/or modified CDS sequence (wt) from SFTSV(SDLZtick12/2010)__JQ684872.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccagtgtgaaggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtacacaagcccggagaagtcgttgtgtcatatggagggatgcgtatcagaccaaagtgctatggtttctccagaatgatggcaacactggaggtgaaccaaccagagcaaaggattggccaatgcactggctgccatctggaatgcataaatgggggtgtgaggctaataaccctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcagtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactgtgagctgcttgatggggaaattgatggataggggaaggcaagtgatccatgaggagataggggagaatagagagggtaaccaagatgatgttaggattgagatggcaagacccagaagggtaaggcattggatgtactcacctgtcatcctaacttttttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcgcctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggctttagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagacagcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggtagctacatgcagacatatcatagcactgtgcccacaggagcaaatatcccaagcccaacagactggctgaatgccttgtttggcaatgggctgagcaggtggatcctgggggtgataggggttctgcttggggggttggctctcttttttatgattatgtctttgttcaagctgggaacaaaacaggtatttcgatcaaggacaaagctggcttag

SEQ ID NO: 4773 - RNA, 3222 nt, synthetic construct
  misc_feature 1..3222: note = derived and/or modified CDS sequence (wt) from SFTSV(Zhao)__KF374684.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgaacggccaacttttgatggatacgtgggctggggctgtggcagtgggaagtcaaggacagagtcaggtgagctctgcagctcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcccggggaagttgttgtgtcatatggagggatgcgtgtcaggccaaagtgttatggtttctccagaatgatggcaacactggaggtgaacccaccagagcaaagaattggccaatgcactggctgccatctagaatgcataaatgggggtgtgaggctagtcactctaactagtgagctcaagtcagctactgtctgtgcttcccacttttgtagttctgccacaagtggcaagaaaagcacggagattcaattccattctgggtcattagttgggaaagcagcaatacacgtcaaaggggctttggtggatggtacagaattcacatttgagggcagttgcatgttcccagatggttgtgacgcagtggactgcacattctgtcgtgagtttctaaaaaatcctcagtgctaccctgcaaagaaatggttgttcattattattgtcatcctccttggatatgcaggcctcatgctactcaccaatgtccttaaagcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggtaagacccagaagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgtaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccaccccatgagcggcatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgcaaactactctgccatacccaccactattggggggctgaggtttgagagaagccatgacagccagggtaaagtatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaaaggggatgagaccgcgttcagtgtactggagggggttcatagctatactgtcagtctcagctttgaccatgcagtggtcgacgagcagtgccagctgaactgtggggggcatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctactggggggattagccctcttcttcttaatcatgtctttgttcaaactgggaacaaaacaggtatttcgatcaaggacgaagctggcttag

SEQ ID NO: 4774 - RNA, 3222 nt, synthetic construct
  misc_feature 1..3222: note = derived and/or modified CDS sequence (wt) from SFTSV(Zhejiang/01/2011)__KJ597824.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgaacggccaacttttgatggatacgtgggctggggctgtggcagtgggaagtcaaggacagagtcaggtgagctctgcagctcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcccggggaagttgttgtgtcatatggagggatgcgtgtcaggccaaagtgttatggtttctccagaatgatggcaacactggaggtgaacccaccagagcaaagaattggccaatgcactggctgccatctagaatgcataaatgggggtgtgaggctagtcactctaactagtgagctcaagtcagctactgtctgtgcttcccacttttgtagttctgccacaagtggcaagaaaagcacggagattcaattccattctgggtcattagttgggaaagcagcaatacacgtcaaaggggctttggtggatggtacagaattcacatttgagggcagttgcatgttcccagatggttgtgatgcagtggactgcacattctgtcgtgagtttctaaaaaatcctcagtgctaccctgcaaagaaatggttgttcattattattgtcatcctccttggatatgcaggcctcatgctactcaccaatgtccttaaagcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggtaagacccagaagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgtaagaagtcatcatcatattttgttcctgatgcacggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccaccccatgagcggcatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgcaaactactctgccatacccaccactattggggggctgaggtttgagagaagccatgacagccagggtaaaatatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaaaggggatgagaccgcgttcagtgtactggagggggttcatagctatactgtcagtctcagctttgaccatgcagtggtcgacgagcagtgccagctgaactgtggggggcatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctactggggggattagccctcttcttcttaatcatgtctttgttcaaactgggaacaaaacaggtatttcgatcaaggacgaagctggcttag

SEQ ID NO: 4775 - RNA, 3222 nt, synthetic construct
  misc_feature 1..3222: note = derived and/or modified CDS sequence (wt) from SFTSV(ZJ2013-06)__KP280204.1__GP
  source 1..3222: mol_type = other RNA
atgatgaaagtcatctggttctcctctctgatctgcttagtcattcaatgcagtggggacacgggcccaatcatatgcgcaggacccatccactcaaacaagagtgccgacataccccacctgcttggttactctgagaagatttgtcagatagatcggctgatacatgtttcgtcatggctgagaaaccattcacaatttcagggctacgtggggcagcgaggtgggcgctcacaggtaagctactacccagctgaaaactcttactcaaggtggagtggacttctaagcccctgtgatgctgattggcttgggatgcttgttgtgaagaaggccaaagggtctgatatgatagttcctgggccttcatacaaggggaaagtcttttttgaacggccaacttttgatggatacgtaggctggggctgtggcagtgggaagtcaaggactgagtcaggagagctctgcagctcagactcagggaccagttcaggtcttctgccctcagatagggttctctggataggtgatgttgcttgccagcctatgacacccatccctgaagagacattcctggagctgaagagttttagccagagtgaattcccagacatatgtaaaattgatggcattgtgtttaaccagtgtgagagtgagagtctacctcaaccctttgatgttgcatggatggatgtaggccactctcataaaatcatcatgagggagcacaagaccaaatgggtgcaagagagctcttctaaggattttgtgtgctacaaggaagggactgggccgtgttctgaatcagaagaaaagacttgcaagaccagtgggtcatgcaggggggacatgcagttttgcaaggtggcaggttgtgagcatggggaagaggcatctgaagccaagtgtagatgctcactagtgcacaagccaggggaagttgttgtgtcatatggagggatgcgtgtcagaccaaagtgttatggtttctccagaatgatggcaacactagaggtgaacccaccagagcaaaggattggccaatgcactggctgccatctagagtgtgtaaatgggggtgtgaggctaatcactctaactagtgagctcaagtcagctactgtctgtgcttcccacttttgtagttctgccacaagtggcaagaaaagcacagagattcaattccactcagggtcattagttgggaaaacagcaatacacgtcaaaggggctttggtggatggaactgaattcacatttgagggcagttgcatgttcccagatggttgtgacgcagtggactgcacgttctgtcgtgagtttctaaaaaatcctcagtgttaccctgcaaagaaatggctgttcatcaatattgtcatcctccttggatatgcaggcctcatgctactcaccaatgtccttaaggcaatcggggtttggggatcatgggtcatagctccagtgaagctaatgtttgccatcataaagaaactgatgagatctgtgagctgcttgatggggaaattaatggataggggaaggcaagtgatccatgaggaaataggggagaatagagagggcaaccaagatgatgttaggatcgagatggcaagacccagaagggtaaggcattggatgtactcacctgtcatcctgactattctagcagttgggcttgctgagggctgcgatgagatggtccatgcagattctaagcttgtttcgtgcaagcaagggagcggaaatatgaaggaatgtgtcacaactgggagggcgctccttcctgcggtgaacccagggcaagaggcatgtctgcacttcacggcacctgggagtccggactcaaaatgtctcaaaattaaggttaagaagattaatctaaaatgtaagaagtcatcatcatattttgtccctgatgctcggtctaggtgtacatctgtgaggagatgtcgctgggcaggagactgccagtctgggtgcccctctcatttcacatccaactccttttctgatgattgggcaggtaaaatggacagggctggtctaggattcagtgggtgctctgatggatgtggaggagcagcctgcggctgctttaatgcagccccttcatgcatcttttggaggaaatgggtagagaacccacatgggatcatctggaaagtatctccatgtgctgcatgggttccatcagcagtcatagagctaacaatgccctcaggggaagtgaggacattccaccctatgagcggcatccccacacaggttttcaagggtgtgagtgtgacttacttaggctcagatatggaggtgtctggcttgactgacctgtgtgagatagaagagctcaagtctaagaagctggcattagccccctgcaatcaggctggcatgggggttgtaggcaaggttggagagatacagtgcagtagcgaggaaagtgcccgcaccataaaaaaagatgggtgtatatggaatgctgaccttgtgggcatagaactacgagtggatgacgctgtgtgctactctaagatcactagtgtggaggcagttgcaaactactctgccatacccaccactattggggggctgaggtttgagagaagccatgacagccagggtaagatatctggtagccccctagacatcacagccataagagggtccttttcagttaattatagaggccttcgactaagcctctcagaaattactgcaacttgcacaggagaggtgacaaatgtgagtggttgttactcttgcatgacaggcgccaaagtctccatcaaactgcatagcaacaaaaatagcactgcccatgtaagatgcaaaggggatgagactgcgttcagcgtcctggagggagttcatagctatactgtcagtctcagctttgaccatgcagtggtcgatgagcagtgccagctgaactgtggggggcatgagagtcaagtgactctaaaaggcaacctcatctttctggatgtcccaaaatttgtagatggcagctatatgcagacatatcatagttctgtacccacaggggctaatatcccaagccctacagactggctgaatgccttgtttggcaatgggctgagtaggtggattctgggggtgataggggttctactggggggattggctctctttttcttaatcatgtctttgttcaaattgggaactaaacaggtatttcgatcaaggacgaagctggcttag

SEQ ID NO: 4776 - RNA, 3222 nt, synthetic construct
  misc_feature 1..3222: note = derived and/or modified CDS sequence (wt) from SFTSV(ZJZHSH-AM/China/05/2012)__KR017846.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgaacggccaacttttgatggatacgtgggctggggctgtggcagtgggaagtcaaggacagagtcaggtgagctctgcagctcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatacagttttgcaaggtggcaggttgtgaacatggggaagaggcatctgaagccaagtgtagatgctcactagtgcacaagcccggggaagttgttgtgtcatatggagggatgcgtgtcaggccaaagtgttatggtttctccagaatgatggcaacactggaggtgaacccaccagagcaaagaattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccattctgggtcattagttgggaaagcagcaatacacgtcaaaggggctttggtggatggtacagaattcacatttgagggcagttgcatgttcccagatggttgtgacgcagtggactgcacattctgtcgtgagtttctaaaaaatcctcagtgctaccctgctaagaaatggttgttcattattattgtcatcctccttggatatgcaggcctcatgctactcaccaatgtccttaaagcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggtaagacccagaagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgcaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccaccccatgagcggaatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgcaaactactctgccatacccaccactattggggggctgaggtttgagagaagccatgacagccagggtaaaatatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaaaggggatgagaccgcgttcagtgtactggagggggttcatagctatactgtcagtctcagctttgaccatgcagtggtcgacgagcagtgccagctgaactgtggggggcatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctactggggggattagccctcttcttcttaatcatgtctttgttcaaactgggaacaaaacaggtatttcgatcaaggacgaagctggcttag

SEQ ID NO: 4777 - RNA, 3222 nt, synthetic construct
  misc_feature 1..3222: note = derived and/or modified CDS sequence (wt) from SFTSV(ZJZHSH-CXD/China/05/2012)__KR017858.1__GP
  source 1..3222: mol_type = other RNA
atgatgaaagtcatctggttctcctctctgatctgcttagtcattcaatgcggtggggatacgggcccaatcatctgcgcaggacccatccactcaaacaagagtgctggcataccccacctgcttggctactctgagaagatttgtcagatagatcggctgatacatgtttcgtcatggctcagaaaccactcacaatttcagggctacgtagggcagcgaggtggacgctctcaggtgagctactacccggctgaaaattcttactcaaggtggagtggacttctaagcccctgtgatgctgattggctagggatgcttgtcgtgaagaaggccaaggggtctgatatgatagttcctgggccctcatacaagggaaaagtcttttttgaacggccaacttttgatggatacgtaggctggggctgtggtagtgggaagtctaggactgagtcaggtgagctctgcagttcagactctgggactagctctggtcttctgccctcagatagggttctctggataggtgatgttgcttgtcagcctatgacacccatccctgaggagacatttctggagctgaagagctttagccaaagtgaattcccagacgtatgcaaaattgatggcattgtgttcaaccagtgtgagggtgagagtctacctcagccctttgatgttgcatggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtacacaagcccggggaagtcgttgtgtcatatggagggatgcgtgtcagaccaaagtgctatggattctccagaatgatggcaacactggaggtgaacccaccagagcaaaggattggtcaatgcactggctgccatctagaatgcataaatggaggtgtgaggctaatcactctaaccagtgagctcaagtcagctactgtctgcgcttctcacttttgtagttctgccacaagtggtaagaaaagcacggagattcaattccactcaggatcattggttggaaaaacagcaatccacgtcaaaggggcattggtagatggaactgaattcacatttgagggtagctgcatgttcccagatggttgtgatgcagtggactgcacattctgtcgtgagtttctaaaaaatcctcagtgctaccctgcaaagaagtggctgttcatcattattgtcatcctcctaggatatgcaggcctcatgctactcaccaatgttcttaaggcaattggggtttgggggtcatgggtcatagctccagtgaagctagtgtttgccatcataaagaaactaatgagagctgtgagctgcctgatggggaaattgatggataggggaaggcaagtgatccatgaggaaataggggagaatagagagggcaaccaaaatgatgttaggatcgagatggccagacccaggagggtaaggcattggatgtactcgcctgtcatcctgactattctagcaatagggtttgctgagggctgtgatgagatggtccatgctgattctaaacttgtttcgtgcaggcaagggagcgaaaatatgaaggaatgtgttacaactgggagggcgcttcttcctgcagtgaaccctgggcaagaggcgtgtctgcacttcacggcacctggaagtccggactcaaaatgtctcaaaattaaggttaagaggatcaacctaaaatgtaagaagtcatcatcatattttgttcctgatgcccggtccaggtgcacatcagtgaggagatgtcgttgggcaggggactgccagtctgggtgcccccctcatttcacatccaactccttttctgatgattgggcaggtaagatggacagggctggtctaggattcagtggctgctctgatgggtgtggaggagcagcctgcggttgctttaatgcggccccttcatgcattttctggaggaaatgggtagagaatccacatgggatcatctggaaagtatctccatgtgccgcatgggtcccatcagcagttatagagctaacaatgccctcaggggaggtgaggacattccaccccatgagcggaatccccacacaagtcttcaagggtgtgagtgtaacttacctgggctcagacatggaggtgtcaggcctgactgacctgtgtgagatagaagagctcaagtcaaagaagcttgcattagctccctgcaaccaggctggtatgggggttgtaggcaaggttggagagatacagtgcagtagcgaggaaagtgcccgtaccataaagaaagatgggtgcatatggaatgctgacctcgtgggtatagagctacgagtggatgacgctgtgtgctactctaagatcactagtgtggaggcagttgcaaactactccgccatacccaccactattggggggctgaggtttgagagaagccatgacagccagggtaaaatatctggaagccccctggacatcacagctataagaggatccttttctgttaattatagaggccttcgactgagtctctcagaaattactgctacttgcacaggggaagtgacaaatgtgagtgggtgttattcttgcatgacaggcgccaaagtctccatcaaattgcatagcagcaaaaatagcactgcccatgtaagatgcaaaggggatgagactgcattcagtgtcttggagggagtccatagctactctgtcagtctaagttttgatcatgcagtagtcgatgagcagtgccaactgaactgtgggggacatgagagtcaagtgactctaagaggcaacctcatcttcctggatgtcccgaaatttgtggatggcagctacatgcagacatatcatagtactgtgcccacaggggcaaacatcccaagccctacagattggctgaatgccttgtttggcaatgggctgagtaggtggattcttggggtgataggggtcctactggggggattggctctctttttcttgatcatgtctttgttcaagctgggaacaaaacaggtatttcgatcgaggacgaagctggcttag

SEQ ID NO: 4778 - RNA, 3222 nt, synthetic construct
  misc_feature 1..3222: note = derived and/or modified CDS sequence (wt) from SFTSV(ZJZHSH-FDE/China/06/2012)__KR017859.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgaacggccaacttttgatggatacgtgggctggggctgtggcagtgggaagtcaaggacagagtcaggtgagctctgcagctcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcccggggaagttgttgtgtcatatggagggatgcgtgtcaggccaaagtgttatggtttctccagaatgatggcaacactggaggtgaacccaccagagcaaagaattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccattctgggtcattagttgggaaagcagcaatacacgtcaaaggggctttggtggatggtacagaattcacatttgagggcagttgcatgttcccagatggttgtgacgcagtggactgcacattctgtcgtgagtttctaaaaaatcctcagtgctaccctgcaaagaaatggttgttcattattattgtcatcctccttggatatgcaggcctcatgctactcaccaatgtccttaaagcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggtaagacccagaagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgtaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccaccccatgagcggcatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgcaaactactctgccatacccaccactattggggggctgaggtttgagagaagccatgacagccagggtaaaatatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaaaggggatgagaccgcgttcagtgtactggagggggttcatagctatactgtcagtctcagctttgaccatgcagtggtcgacgagcagtgccagctgaactgtgggggacatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctactggggggattagccctcttcttcttaatcatgtctttgttcaaactgggaacaaaacaggtatttcgatcaaggacgaagctggcttag

SEQ ID NO: 4779 - RNA, 3222 nt, synthetic construct
  misc_feature 1..3222: note = derived and/or modified CDS sequence (wt) from SFTSV(ZJZHSH-FZHR/China/07/2013)__KR017862.1__GP
  source 1..3222: mol_type = other RNA
atgatgaaagtcatctggttctcctctctgatctgcttagtcattcaatgcggtggggatacgggcccaatcatctgcgcaggacccatccactcaaacaagcgtgctggcataccccacctgcttggctactctgagaagatttgtcagatagatcggctgatacatgtttcgtcatggctcagaaaccactcacaatttcagggctacgtagggcagcgaggtggacgctctcaggtgagctactacccggctgaaaattcttactcaaggtggagtggacttctaagcccctgtgatgctgattggctagggatgcttgtcgtgaagaaggccaaggggtctgatatgatagttcctgggccttcatacaagggaaaagtcttttttgaacggccaacttttgatggatacgtaggctggggctgtggtagtgggaagtctagaactgagtcaggtgagctctgcagttcagactccgggactagctctggtcttctgccctctgatagggttctctggataggtgatgttgcttgtcagcctatgacacccatccctgaggagacatttctggagctgaagagctttagccaaagtgaattcccagacgtatgcaaaattgatggcattgtgttcaaccagtgtgagggtgagagtctacctcagccctttgatgttgcatggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagcccggggaagtcgttgtgtcatatggagggatgcgtgtcagaccaaagtgctatggattctccagaatgatggcaacactggaggtgaacccaccagagcaaaggattggtcaatgcactggctgccatctagaatgcataaatggaggtgtgaggctaatcactctaaccagtgagctcaagtcagctactgtctgcgcttctcacttttgtagttctgccacaagtggtaagaaaagcacggagattcaattccactcaggatcattggttggaaaaacagcaatccacgtcaaaggggcattggtagatggaactgaattcacatttgagggtagctgcatgttcccagatggttgtgatgcagtggactgcacattctgtcgtgagtttctaaaaaatcctcagtgctaccctgcaaagaagtggctgttcatcattattgtcatcctcctaggatatgcaggcctcatgctactcaccaatgttcttaaggcaattggggtttgggggtcatgggtcatagctccagtgaagctagtgtttgccatcataaagaaactaatgagagctgtgagctgcctgatggggaaattgatggataggggaaggcaagtgatccatgaggaaataggggagaatagagagggcaaccaagatgatgttaggatcgagatggccagacccaggagggtgaggcattggatgtactcgcctgtcatcctgactattctagcaatagggcttgctgagggctgtgatgagatggtccatgctgattctaaacttgtttcgtgcaggcaagggagcggaaatatgaaggaatgtgttacaactgggagggcgcttcttcctgcggtgaaccctgggcaagaggcgtgtctgcacttcacggcacctggaagtccggactcaaaatgtctcaaaattaaggttaagaggatcaacctaaaatgtaagaagtcatcatcatattttgttcctgatgcccggtccaggtgcacatcagtgaggagatgtcgttgggcaggggactgccagtctgggtgcccccctcatttcacatccaactccttttctgatgattgggcaggtaagatggacagggctggtctaggattcagtggctgctctgatgggtgtggaggagcagcctgcggttgctttaatgcggccccttcatgcattttctggaggaaatgggtagagaatccacatgggatcatctggaaagtatctccatgtgccgcatgggtcccatcagcagttatagagctaacaatgccctcaggggaggtgaggacattccaccccatgagcggaatccccacacaagtcttcaagggtgtgagtgtaacttacctgggctcagacatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaagaaagatgggtgcatatggaatgctgacctcgtgggtatagagctacgagtggatgacgctgtgtgctactctaagatcactagtgtggaggcagttgcaaactactccgccatacccaccactattggggggctgaggtttgagagaagccatgacagccagggtaaaatatctggaagccccctggacatcacagctataagaggatccttttctgttaattatagaggccttcgactgagtctctcagaaattactgctacttgcacaggggaagtgacaaatgtgagtgggtgttattcttgcatgacaggcgccaaagtctccatcaaattgcatagcagcaaaaatagcactgcccatgtaagatgcaaaggggatgagactgcattcagtgtcttggagggagtccatagctactctgtcagtctaagttttgatcatgcagtagtcgatgagcagtgccaactgaactgtgggggacatgagagtcaagtgactctaagaggcaacctcatcttcctggatgtcccgaaatttgtggatggcagctacatgcagacatatcatagtactgtgcccacaggggcaaatatcccaagccctacagattggctgaatgccttgtttggcaatgggctgagtaggtggattcttggggtgataggggtcctactggggggattggctctctttttcttgattatgtctttgttcaagctgggaacaaaacaggtatttcgatcgaggacgaagctggcttag

SEQ ID NO: 4780 - RNA, 3222 nt, synthetic construct
  misc_feature 1..3222: note = derived and/or modified CDS sequence (wt) from SFTSV(ZJZHSH-HCY/China/06/2012)__KR017855.1__GP
  source 1..3222: mol_type = other RNA
atgatgaaagtcatctggttcccctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgaacggccaacttttgatggatacgtgggctggggctgtggcagtgggaagtcaaggacagagtcaggtgagctctgcagctcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcccggggaagttgttgtgtcatatggagggatgcgtgtcaggccaaagtgttatggtttctccagaatgatggcaacactggaggtgaacccaccagagcaaagaattggccaatgcactggctgccatctagaatgcataaatgggggtgtgaggctagtcactctaactagtgagctcaagtcagctactgtctgtgcttcccacttttgtagttctgccacaagtggcaagaaaagcacggagattcaattccattctgggtcattagttgggaaagcagcaatacacgtcaaaggggctttggtggatggtacagaattcacatttgagggcagttgcatgttcccagatggttgtgacgcagtggattgcacattctgtcgtgagtttctaaaaaatcctcagtgctaccctgcaaagaaatggttgttcattattattgtcatcctccttggatatgcaggcctcatgctactcaccaatgtccttaaagcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggtaagacccagaagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgtaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccaccccatgagcggcatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgcaaactactctgccataccaaccactattggggggctgaggtttgagagaagccatgacagccagggtaaaatatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaaaggggatgagaccgcgttcagtgtactggagggggttcatagctatactgtcagtctcagctttgaccatgcagtggtcgacgagcagtgccagctgaactgtggggggcatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctactggggggattagccctcttcttcttattcatgtctttgttcaaactgggaacaaaacaggtatttcgatcaaggacgaagctggcttag

SEQ ID NO: 4781 - RNA, 3222 nt, synthetic construct
  misc_feature 1..3222: note = derived and/or modified CDS sequence (wt) from SFTSV(ZJZHSH-HYC/China/05/2012)__KR017847.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgaacggccaacttttgatggatacgtgggctggggctgtggcagtgggaagtcaaggacagagtcaggtgagctctgcagctcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcccggggaagttgttgtgtcatatggagggatgcgtgtcaggccaaagtgttatggtttctccagaatgatggcaacactggaggtgaacccaccagagcaaagaattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccattctgggtcattagtcgggaaagcagcaatacacgtcaaaggggctttggtggatggtacagaattcacatttgagggcagttgcatgttcccagatggttgtgacgcagtggactgcacattctgtcgtgagtttctaaaaaatcctcagtgctaccctgcaaagaaatggttgttcattattattgtcatcctccttggatatgcaggcctcatgctactcaccaatgtccttaaagcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagaaagggcaaccaagatgatgttaggatcgagatggtaagacccagaagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgcaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccaccccatgagcggcatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgcaaactactctgccatacccaccactattggggggctgaggtttgagagaagccatgacagccagggtaaaatatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaaaggggatgagaccgcgttcagtgtactggagggggttcatagctacactgtcagtctcagctttgaccatgcagtggtcgacgagcagtgccagctgaactgtggggggcatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctactggggggattagccctcttcttcttaatcatgtctttgttcaaactgggaacaaaacaggtttttcgatcaaggacgaagctggcttag

SEQ ID NO: 4782 - RNA, 3222 nt, synthetic construct
  misc_feature 1..3222: note = derived and/or modified CDS sequence (wt) from SFTSV(ZJZHSH-HYJ/China/07/2012)__KR017852.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgaacggccaacttttgatggatacgtgggctggggctgtggcagtgggaagtcaaggacagagtcaggtgagctctgcagctcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcccggggaagttgttgtgtcatatggagggatgcgtgtcaggccaaagtgttatggtttctccagaatgatggcaacactggaggtgaacccaccagagcaaagaattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccattctgggtcattagttgggaaagcagcaatacacgtcaaaggggctttggtggatggtacagaattcacatttgagggcagttgcatgttcccagatggttgtgacgcagtggactgcacattctgtcgtgagtttctaaaaaatcctcagtgctaccctgcaaagaaatggttgttcattattattgtcatcctccttggatatgcaggcctcatgctactcaccaatgtccttaaagcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggtaagacccagaagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaagtcaaggttaagaggatcaacctaaaatgtaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccaccccatgagcggcatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgcaaactactctgccatacccaccactattggggggctgaggtttgagagaagccatgacagccagggtaaaatatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaagggggatgagaccgcgttcagtgtactggagggggttcatagctacactgtcagtctcagctttgaccatgcagtggtcgacgagcagtgccagctgaactgtggggggcatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctactggggggattagccctcttcttcttaatcatgtctttgttcaaactgggaacaaaacaggtatttcgatcaaggacgaagctggcttag

SEQ ID NO: 4783 - RNA, 3222 nt, synthetic construct
  misc_feature 1..3222: note = derived and/or modified CDS sequence (wt) from SFTSV(ZJZHSH-LU/China/10/2011)__KR017850.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgaacggccaacttttgatggatacgtgggctggggctgtggcagtgggaagtcaaggacagagtcaggtgagctctgcagctcagactcagggaccagttctggtcttctgccctcagatagggttctctggataggtgatgttgcttgccagcctatgacacccatccctgaggagacatttctggagctgaagagttttagccagagtgaattcccagacatgtgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcccggggaagttgttgtgtcatatggagggatgcgtgtcaggccaaagtgttatggtttctccagaatgatggcaacactggaggtgaacccaccagagcaaagaattggccaatgcactggctgccatctagaatgcataaatgggggtgtgaggctagtcactctaactagtgagctcaagtcagctactgtctgtgcttcccacttttgtagttctgccacaagtggcaagaaaagcacggagattcaattccattctgggtcattagttgggaaagcagcaatacacgtcaaaggggctttggtggatggtacagaattcacatttgagggcagttgcatgttcccagatggttgtgacgcagtggactgcacattctgtcgtgagtttctaaaaaatcctcagtgctaccctgcaaagaaatggttgttcattattattgtcatcctccttggatatgcaggcctcatgctactcaccaatgtccttaaagcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggtaagacccagaagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgtaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccaccccatgagcggcatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgcaaactactctgccataccaaccactattggggggctgaggtttgagagaagccatgacagccagggtaaaatatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaaaggggatgagaccgcgttcagtgtactggagggggttcatagctatactgtcagtctcagctttgaccatgctgtggtcgacgagcagtgccagctgaactgtggggggcatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctgctggggggattagccctcttcttcttaatcatgtctttgttcaaactgggaacaaaacaggtatttcgatcaaggacgaagctggcttag

SEQ ID NO: 4784 - RNA, 3222 nt, synthetic construct
  misc_feature 1..3222: note = derived and/or modified CDS sequence (wt) from SFTSV(ZJZHSH-SHZ/China/05/2012)__KR017848.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgaacggccaacttttgatggatacgtgggctggggctgtggcagtgggaagtcaaggacagagtcaggtgagctctgcagttcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcccggggaagttgttgtgtcatatggagggatgcgtgtcaggccaaagtgttatggtttctccagaatgatggcaacactggaggtgaacccaccagagcaaagaattggccaatgcactggctgccatctagaatgcataaatgggggtgtgaggctagtcactctaactagtgagctcaagtcagctactgtctgtgcttcccacttttgtagttctgccacaagtggcaagaaaagcacggagattcaattccattctgggtcattagttgggaaagcagcaatacacgtcaaaggggctttggtggatggtacagaattcacatttgagggcagttgcatgttcccagatggttgtgacgcagtggactgcacattctgtcgtgagtttctaaaaaatcctcagtgctaccctgcaaagaaatggttgttcattattattgtcatcctccttggatatgcaggcctcatgctactcaccaatgtccttaaagcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggtaagacccagaagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgtaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccaccccatgagcggcatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgcaaactactctgccataccaaccactattggggggctgaggtttgagagaagccatgacagccagggtaaaatatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaaaggggatgagaccgcgttcagtgtactggagggggttcatggctatactgtcagtctcagctttgaccatgcagtggtcgacgagcagtgccagctgaactgtggggggcatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctactggggggattagccctcttcttcttaatcatgtctttgttcaaactgggaacaaaacaggtatttcgatcaaggacgaagctggcttag

SEQ ID NO: 4785 - RNA, 3222 nt, synthetic construct
  misc_feature 1..3222: note = derived and/or modified CDS sequence (wt) from SFTSV(ZJZHSH-WSH/China/08/2012)__KR017854.1__GP
  source 1..3222: mol_type = other RNA
atgatgaaagtcatctggttctcctctctgatctgcttagtcattcaatgcggtggggatacgggcccaatcatctgcgcaggacccatccactcaaacaagagtgctggcataccccacctgcttggctactctgagaagatttgtcagatagatcggctgatacatgtttcgtcatggctcagaaaccactcacaatttcagggctacgtagggcagcgaggtggacgctctcaggtgagctactacccggctgaaaattcttactcaaggtggagtggacttctaagcccctgtgatgctgattggctagggatgcttgtcgtgaagaaggccaaggggtctgatatgatagttcctgggccctcatacaagggaaaagtcttttttgaacggccaacttttgatggatacgtaggctggggctgtggtagtgggaagtctaggactgagtcaggtgagctctgcagttcagactccgggactagctctggtcttctgccctcagatagggttctctggataggtgatgttgcttgtcagcctatgacacccatccctgaggagacatttctggagctgaagagctttagccaaagtgaattcccagacgtatgcaaaattgatggcattgtgttcaaccagtgtgagggtgagagtctacctcagccctttgatgttgcatggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcaaaagcccggggaagtcgttgtgtcatatggagggatgcgtgtcagaccaaagtgctatggattctccagaatgatggcaacactggaggtgaacccaccagagcaaaggattggtcaatgcactggctgccatctagaatgcataaatggaggtgtgaggctaatcactctaaccagtgagctcaagtcagctactgtctgcgcttctcacttttgtagttctgccacaagtggtaagaaaagcacggagattcaattccactcaggatcattggttggaaaaacagcaatccacgtcaaaggggcattggtagatggaactgaattcacatttgagggtagctgcatgttcccagatggttgtgatgcagtggactgcacattctgtcgtgagtttctaaaaaatcctcagtgctaccctgcaaagaaatggttgttcattattattgtcatcctccttggatatgcaggcctcatgctactcaccaatgtccttaaagcaatcggggtttggggatcatgggtcatagctccagtgaagctaatgtttgccatcatgaagaaactgatgagatctgtgagctgcttgatggggaaattgatggataggggaaggcaagtgatccatgaagaaataggggagaatagagagggcaaccaagatgatgttaggatcgagatggtaagacccagaagggtgaggcattggatgtactctcctgtcatcctgactattctagcaattgggcttactgagggctgcgatgagatggtccatgcagattctaaacttgtttcgtgcaggcaagggagcggaaatatgaaggaatgtgtcacaactgggagggcgctccttcctgcggtgaaccctgggcaagaggcgtgtctgcacttcacggcacctggaagtccggactcaaaatgtctcaaaattaaggttaagaggatcaacctaaaatgtaagaagtcatcatcatattttgttcctgatgcccggtccaggtgcacatcagtgaggagatgtcgttgggcaggggactgccagtctgggtgcccccctcatttcacatccaactccttttctgatgattgggcaggtaagatggacagggctggtctaggattcagtggctgctctgatgggtgtggaggagcagcctgcggttgctttaatgcggccccttcatgcattttctggaggaaatgggtagagaatccacatgggatcatctggaaagtatctccatgtgccgcatgggtcccatcagcagttatagagctaacaatgccctcaggggaggtgaggacattccaccccatgagcggaatccccacacaagtcttcaagggtgtgagtgtaacttacctgggctcagacatggaggtgtcaggcctgactgacctgtgtgagatagaagagctcaagtcaaagaagcttgcattagctccctgcaaccaggctggtatgggggttgtaggcaaggttggagagatacagtgcagtagcgaggaaagtgcccgtaccataaagaaagatgggtgcatatggaatgctgacctcgtgggtatagagctacgagtggatgacgctgtgtgctactctaagatcactagtgtggaggcagttgcaaactactccgccatacccaccactattggggggctgaggtttgagagaagccatgacagccagggtaaaatatctggaagccccctggacatcacagctataagaggatccttttctgttaattatagaggccttcgactgagtctctcagaaattactgctacttgcacaggggaagtgacaaatgtgagtgggtgttattcttgcatgacaggcgccaaagtctccatcaaattgcatagcagcaaaaatagcactgcccatgtaagatgcaaaggggatgagactgcattcagtgtcttggagggagtccatagctactctgtcagtctaagttttgatcatgcagtagtcgatgagcagtgccaactgaactgtgggggacatgagagtcaagtgactctaagaggcaacctcatcttcctggatgtcccgaaatttgtggatggcagctacatgcagacatatcatagtactgtgcccacaggggcaaatatcccaagccctacagattggctgaatgccttgtttggcaatgggctgagtaggtggattcttggggtgataggggtcctactggggggattggctctctttttcttgatcatgtctttgttcaagctgggaacaaaacaggtatttcgatcgaggacgaagctggcttag

SEQ ID NO: 4786 - RNA, 3222 nt, synthetic construct
  misc_feature 1..3222: note = derived and/or modified CDS sequence (wt) from SFTSV(ZJZHSH-XAM/China/06/2012)__KR017853.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgccagatagatcggctgatacatgtttcgtcatggctgagaaaccattcacaatttcagggctacgtggggcagcgaggtggacgctctcaggtgagttactacccagctgaaaactcttactcaaggtggagtggacttctaagcccctgtgatgctgattggcttggaatgcttgtcgtgaagaaggccaaggggtctgatatgatagttcctgggccttcatacaagggaaaagtcttttttgagcggccaacttttgatggatacgtgggctggggctgtggcagtgggaagtcaaggacagagtcaggtgagctctgcagctcagactcagggaccagttctggtcttctgccctcagatagggttctctggataggtgatgttgcttgccagcctatgacacccatccctgaggagacatttctggagctgaagagttttagccagagtgaattcccagacatatgcaagattgatggcattgtgttcaaccagtgtgagagtgagagtctacctcagccctttgatgtcgcatggatggatgtaggtcactctcataaaatcatcatgagggagcacaagaccaaatgggtacaggagagctcatctaaggactttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcactagtgcacaagcccggggaagttgttgtgtcatatggagggatgcgtgtcaggccaaagtgttatggtttctccagaatgatggcaacactggaggtgaacccaccagagcaaagaattggccaatgcactggctgccatctagaatgcataaatgggggtgtgaggctagtcaccctaactagtgagctcaagtcagctactgtctgtgcttcccacttttgtagttctgccacaagtggcaagaaaagcacggagattcaattccattctgggtcattagttgggaaagcagcaatacacgtcaaaggggctttggtggatggtacagaattcacatttgagggcagttgcatgttcccagatggttgtgatgcagtggactgcacattctgtcgtgagtttctaaaaaatcctcagtgctaccctgcaaagaagtggctgttcatcattattgtcatcctcctaggatatgcaggcctcatgctactcaccaatgttcttaaggcaattggggtttgggggtcatgggtcatagctccagtgaagctagtgtttgccatcataaagaaactaatgagagctgtgagctgcctgatggggaaattgatggataggggaaggcaagtgatccatgaggaaataggggagaatagagagggcaaccaagatgatgttaggatcgagatggccagacccaggagggtaaggcattggatgtactcgcctgtcatcctgactattctagcaatagggcttgctgagggctgtgatgagatggtccatgctgattctaaacttgtttcgtgcaggcaagggagcggaaatatgaaggaatgtgtcacaactgggagggcgctccttcctgcggtgaacccaggacaagaggcatgtctgcacttcacggcacctgggagtccggactcaaaatgtctcaaaatcaaggttaagaggatcaacctaaaatgtaagaagtcatcatcatattttgttcctgatgctcggtccaggtgtacatctgtgaggagatgtcgctgggcaggagactgccagtctgggtgcccctctcatttcacgtccaactccttctctgatgattgggcaggtaaaatggatagggctggtctaggatttagtgggtgctctgatgggtgtggaggagcagcctgcggctgctttaatgcggccccttcatgcatcttttggaggaaatgggtagagaatccacatgggatcatctggaaagtatctccatgtgctgcatgggtcccttcagcagtcatagagctaacaatgccctcgggggaagtgaggacattccaccccatgagcggcatcccaacacaagtcttcaagggtgtgagtgtgacttacttaggctcagatatggaggtgtctggcttgactgacctgtgtgagatagaagagctcaagtccaagaagctggcattagctccctgcaatcaggctggcatgggggttgtaggcaaggttggagagatacagtgcagtagcgaggaaagcgctcgtaccataaagaaagatgggtgtatatggaatgctgaccttgtgggcatagagctacgagtggatgacgctgtgtgctactctaagatcactagtgtggaggcagttgcaaactactctgccataccaaccactattggggggctgaggtttgagagaagccatgacagccagggtaaaatatctggtagccccctagacatcacagccataagagggtctttttcagttaattatagaggccttcgactgagcctctcagaaatcactgctacttgcacaggagaggtgacgaatgtgagtggatgttactcttgcatgacaggtgccaaagtctccatcaaactgcatagcagcaaaaatagcactgcccatgtgagatgcaaaggggatgagaccgcgttcagtgtactggagggggttcatagctatactgtcagtctcagctttgaccatgcagtggtcgacgagcagtgccagctgaactgtggggggcatgagagtcaagtgactctaaaaggcaacctcatcttcctggatgtcccaaaatttgtagatggcagctatatgcagacatatcatagttctgtgcccacaggagctaatatcccaagcccaacagactggctgaatgccttgtttggcaatgggctgagtaggtggattctgggggtgataggggttctactggggggattagccctcttcttcttaatcatgtctttgttcaaactgggaacaaaacaggtatttcgatcaaggacgaagctggcttag

SEQ ID NO: 4787 - RNA, 3222 nt, synthetic construct
  misc_feature 1..3222: note = derived and/or modified CDS sequence (wt) from SFTSV(ZJZHSH-YJX/China/06/2012)__KR017860.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggctactctgagaagatttgtcagatagatcggctgatacatgtttcgtcatggctgagaaaccattcacaatttcagggctatgtggggcagcgaggtggacgctctcaggtaagctattacccagctgaaaactcttactcaaggtggagtggacttctaagcccctgtgatgctgattggcttgggatgcttgttgtgaagaaggccaaagggtctgatatgatagttcctgggccttcatacaagggaaaagtcttttttgaacggccaacttttgatggatacgtaggctggggctgtggcagtgggaagtcaaggacagagtcaggggagctctgcagctcagactcagggaccagttccggtcttctgccctcagatagggttctctggataggtgatgttgcttgccagcccatgacacccatccctgaggagacatttctggagctgaagagttttagccagagtgaattcccagacatatgcaaaattgatggcattgtgttcaaccagtgtgagagtgagagtctacctcaaccctttgatgttgcgtggatggatgtaggccactctcataaaatcatcatgagggagcacaagactaaatgggtacaagagagctcatctaaggattttgtgtgctacaaggaagggactgggccatgttctgaatcagaagaaaagacttgcaagaccagtggatcatgcaggggggacatgcagttttgcaaggtggcaggttgtgaacatggggaagaagcatctgatgccaagtgtagatgctcactagtgcacaagcccggggaagttgttgtgtcatatggagggatgcgtgtcagaccaaagtgttatggcttctccagaatgatggcaacactagaggtgaacccaccagagcaaaggattggccaatgcactggctgccatcttgaatgcataaatgggggtgtgaggctaatcactctgactagtgagctcaggtcagctactgtctgtgcttcccacttttgtagttctgccacaagtggcaagaaaagcacggaaattcaattccactcagggtcattagttgggaaaacaacaatacacgtcaaaggggctttggtggatggaactgaattcacatttgagggcagttgcatgttcccagatggttgtgacgcagtggactgcacattctgtcgtgagtttctaaaaaatcctcagtgctaccctgcaaagaaatggctgttcatcattattgtcatcctccttggatatgcaggcctcatgctacttaccaatgtccttaaggcaatcggggtttggggatcatgggtcatagctccagtgaagctaatgtttgccatcataaagaaactgatgagatctgtgagctgcttgatggggaaattaatggataggggaaggcaagtgatccatgaagaaataggggagaatagagagggcaaccaagatgatgttaggatcgagatggcaagacccagaagggtaaggcattggatgtactcacctgtcatcctgaccattctagcaattgggcttgccgagggctgcgatgagatggtccatgcagactccaaacttgtttcgtgcaagcaagcgagcggaaacatgaaggaatgtgtcacaactgggagggcactccttcctgcggtgaacccaggacaagaggcatgtctgcacttcacggcacctgggagtccggactcaaaatgtctcaaaattaaggtcaagaggattaacctaaaatgtaagaagtcatcatcatattttgttcttgatgctcggtctaggtgtacatctgtgaggagatgtcgctgggcaggagactgccagtctgggtgcccctctcatttcacgtccaactccttttctgatgattgggcaggtaaaatggacagggcaggtctaggattcagtgggtgctctgatggatgtggaggagcagcctgcggctgctttaatgcagccccttcatgcatcttttggaggaaatgggtagagaacccgcatgggatcatctggaaagtatctccatgtgctgcatgggtcccatcagcagtcatagagctaacaatgccctcaggggaagtgaggacattccaccccatgagcggcatccctacacaagtcttcaagggtgtgagtgtgacgtacttaggctcagatatggaggtgtctggcttgactgacctgtgtgagatagaagaactcaagtccaagaagctagcattagccccctgcaatcaggctggcatgggggttgtaggcaaggttggagagatacagtgcagtagcgaggaaagtgcccgtaccataaaaaaagatgggtgtatatggaatgctgaccttgtgggcatagagctacgagtggatgacgctgtgtgctactctaagatcactagtgtggaggcagttgcaaactactctgccatacccaccactattggggggctgaggtttgagagaagccatgacagccagggtaaaatatctggtagccccttagatataacagccataagagggtctttttcagttaattatagaggccttcgactgagcctctcagaggttactgctacttgcacaggagaggtgacgaatgtgagtgggtgttactcttgcatgacaggcgccaaagtctccatcaaactgcatagcagcaaaaatagcactgcccatgtaagatgcaaaggggatgagacagcattcagtgtcctagagggagttcatagctatactgtcagtctcagctttgaccatgcagtggtcgatgagcagtgccagctgaactgtggagggcatgagagtcaagtgactctaaaaggaaacctcatcttcctggatgtcccaaaatttgtagatggcagctatatgcagacatatcatagttctgtgctcacaggggccaacatcccaagccctacagactggctgaatgccttgttcggcaatgggctgagtaagtggattctgggggtaataggggttctactggggggattggctctctttttcttaatcatgtctctgttcaaattgggaacaaaacagatatttcgatcaaggacgaagctggcttaa

SEQ ID NO: 4788 - RNA, 3222 nt, synthetic construct
  misc_feature 1..3222: note = derived and/or modified CDS sequence (wt) from SFTSV(SPL003A)__AB817988.1__GP
  source 1..3222: mol_type = other RNA
atgatgaaagtcatctggttctcctctctgatctgcttagtcatccaatgcagtggggatacgggcccaatcatatgcgcagggcccatccactcaaacaagagtgccaacataccccacctgcttggttattctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccgtgtgatgctgattggcttgggatgcttgtcgtgaagaaggccaaggggtctgatatgatagttcctgggccttcatacaagggaaaagtcttttttgaacggccaacatttgatggatacgttggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctgaagagctttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgtaggggggacatgcagttttgcaaggtggcaggttgtgaacatggggaagaggcatctgaagccaaatgcagatgctcactagtgcacaagcccggggaagttgttgtgtcatatggagggatgcgtgtcagaccaaagtgctatggtttctccagaatgatggcaacactagaggtgaactcaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggcaaggcctagaagggtaaggcactggatgtactcccctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcggtgaatccaggacaagaggcatgtctgcacttcacagcaccagggagcccggactcaaaatgtctcaaaatcaaagttaagaggatcaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgatgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcaggggaagtgaggacattccaccccatgagcggcatccctactcaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacaatgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggcaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccagggtctccatcaaactgcatagcagcaaaaatagcactgcacatgtaaggtgcaaaggggatgagactgcgttcagtgtcctggagggagttcatagctatactgtcagcctcagctttgaccatgctgtggtcgatgagcagtgccaactgaactgtggggggcatgagagtcaagtgactctaaaaggcaacctcatcttcctggatgtcccaaaattcgtagatggcagctacatgcagacatatcatagttctgtacccacaggagcaaatatcccaagcccaacagactggctgaatgccctgtttggcaatgggctgagtaggtggattctgggggtgataggggttctactggggggattggctctctttttcttaatcatgtctttgttcaaactgggaacaaaacaggtatttcgatcaaggacgaagctggcttag

SEQ ID NO: 4789 - RNA, 3222 nt, synthetic construct
  misc_feature 1..3222: note = derived and/or modified CDS sequence (wt) from SFTSV(SPL004A)__AB817989.1__GP
  source 1..3222: mol_type = other RNA
atgatgaaagtcatctggttctcctctctgatctgcttggtcattcaatgcagtggggacacgggcccaatcatatgtgcagggcccatccactcaaacaagagtgccaacataccccacctgcttggttactctgagaagatttgtcagatagatcgactgatacatgtttcgtcatggctgagaaaccattcacagtttcagggctacgtggggcagcgaggtggacgctctcaggtgagctactacccagctgaaaactcttactcaaggtggagcggacttctaagcccctgtgatgctgattggcttgggatgcttgttgtgaagaaggccaaggggtctgatatgatagttcctggaccatcatacaaggggaaagtcttttttgagcggccaacttttgatggatacgtgggctggggctgtggtagtgggaagtcaaggacagagtcaggtgaactctgcagctcagactcagggaccagttctggtcttctgccctcagatagagttctctggataggtgatgttgcttgccagcctatgacacccatccctgaggagacatttctggagctgaagagttttagccagagtgaattcccagacatatgcaagattgatggcattgtgttcaatcagtgtgagagtgagagtttacctcagccctttgatgtcgcatggatggatgtaggtcactctcataaaatcatcatgagggagcacaagaccaaatgggtacaagagagctcatctaaggattttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgttctctagtgcacaagcccggggaagttgttgtgtcatatggagggatgcgtgtcagaccaaagtgttatggtttctccagaatgatggcaacactagaggtgaacccaccagagcaaaggattggccaatgcactggctgccatctagaatgcataagtgggggtgtgaggctaatcactctaactagtgagctcaagtcagccactgtctgtgcttcccacttttgtagttctgccacaagtggcaagaaaagcacggagattcaattccactcagggtcattagttgggaaagcagcaatacacgtcaaaggggctttggtggatggaactgaattcacatttgagggtagttgcatgttcccagatggttgtgacgcagtggattgcacattctgtcgtgagtttctaaagaatcctcagtgctaccctgcaaagaaatggttgttcattattattgtcatcctccttggatatgcaggcctcatgctactcaccaatgtccttaaggcaatcggggtttggggatcatgggtcatagctccagtgaagctaatgtttgccatcatgaagaaactgatgagatctgtgagctgcttgatggggaaattgatggataggggaaggcaagtgatccatgaagaaataggggagaatagagagggcaaccaagatgatgttaggatcgagatggcaagaccgagaagggtgaggcattggatgtactcacctgtcatcctgactattctagcaattgggctagctgagggctgcgatgagatggtccatgctgattctaaacttgtttcgtgcaggcaagggagtgggaacatgaaagaatgtgtcacaactgggagggcgctccttcctgcggtgaaccctggacaagaggcatgtctgcacttcacggcacctgggagcccggactcaaaatgtctcaagatcaaggttaagaggatcaacctaaaatgtaagaagtcatcatcatattttgttcctgatgctagatccaggtgtacatctgtgaggagatgtcgctgggcaggagactgtcagtctgggtgcccctctcatttcacgtccaactccttctctgatgattgggcaggtaaaatggacagggctggtctaggattcagtgggtgctctgatggatgtggaggagcagcctgcggctgctttaatgcggccccttcatgcatcttttggaggaaatgggtagagaatccacatgggatcatctggaaagtatctccatgtgctgcatgggtcccatcagcagtcatagagctaacgatgccctcgggggaagtgaggacattccaccccatgagtggcatccccacacaagtcttcaagggtgtgagtgtgacttacttaggctcagatatggaggtgtctggcttgactgacctgtgtgagatagaagagctaaagtccaagaagctggcattagctccctgcaatcaggctggcatgggggtagtaggcaaggttggagagatacagtgcagcagcgaggaaagcgcccgtactataaagaaagatgggtgcatatggaatgctgaccttgtaggcatagagctacgggtggatgacgctgtgtgctactctaagatcactagtgtggaggcagttgcaaactactctgccatacccaccactattggggggctgaggtttgagagaagccatgacagccagggtaaaatatctggtagccccctagacatcacagccataagagggtctttttcagttaattatagaggccttcgactgagcctctcagaaattactgccacttgcactggggaggtgacgaatgtgagtgggtgttactcttgcatgacaggcgccaaagtctccatcaaactgcatagcagcaaaaatagcactgcccatgtaagatgcaaagaggatgagaccgcgtttagtgtcctggagggagttcatagctatactgtcagtctcagctttgaccatgcagtggtcgatgagcagtgccagctgaactgtggggggcatgagagtcatgtgactctaaaaggcaaccttatcttcctggatgtcccaaaatttgtagatggcagctatatgcagacatatcatagttctgtgcccacaggggctaatatcccaagcccgacagactggctgaatgccttgtttggcaatgggctgagtagatggattctgggggtgatgggggttctgctgggggggttggctctcttcttcttaatcatgtctttgttcaaactgggaacaaaacaggtatttcgatcaaggacgaagctggcttag

SEQ ID NO: 4790 - RNA, 3222 nt, synthetic construct
  misc_feature 1..3222: note = derived and/or modified CDS sequence (wt) from SFTSV(SPL005A)__AB817990.1__GP
  source 1..3222: mol_type = other RNA
atgatgaaagtcatctggttctcctctctgatctgcttagtcattcaatgcagtggggatgcgagcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtcttttttgaacggccaacttttgatggatacgttggctggggctgtggcagtgggaagtcaaggactgagtcaggggagctctgcagctcagactcagggaccagttccggtcttctgccctcagatagggttctctggataggtgatgttgcttgccagcctatgacacccatccctgaagagacatttctggagctgaagagttttagccagagtgaatttccagacatatgcaaaattgatggcattgtgttcaaccagtgtgagagtgagagcctacctcagccccttgatgttgcttggatggatgttggccactctcataaaatcatcatgagggagcacaagaccaaatgggtgcaagagagctcatctaaggattttgtgtgctacaaggaagggactgggccgtgttctgaatcagaagaaaagacttgcaagaccagtggatcatgtaggggggacatgcagttttgcaaggtggcaggttgtgaacatggggaagaggcatctgaagccaagtgcagatgctcactagtgcacaagcccggggaagttgttgtgtcatatggagggatgcgtgtcagaccaaagtgctatggtttctccagaatgatggcaacactagaggtgaacccactagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaagctgatgagatctgtgagctgcttgatggggaaattgatggataggggaaggcaagtgatccatgaagaaataggggagaatagagagggcaaccaagatgatgtcaggatcgagatggcaaggcctagaagggtaaggcactggatgtactcacctgtcatcctgactattctagcaattgggcttgctgagggctgcgatgagatggtccatgcagattctaaacttgtttcgtgtaagcaagggggcggaaatatgaaggaatgtgtcacaactgggagggcgctccttcctgcggtgaacccaggacaagaggcatgtctgcacttcacagcaccagggagtccggactcaaaatgtctcaaaatcaaagttaagaggatcaacctgaaatgcaagaagtcatcatcatattttgttcctgatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcaggggaagtgaggacattccaccccatgagcggcatccctactcaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacagtgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactcagccatacccaccactattgggggactgaggtttgagagaagccatgacagccagggcaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagcctcagttttgaccatgcagtggtcgatgagcagtgccagctgaactgtggggggcatgagagtcaagtgactctaaaaggcaacctcatcttcctggatgtcccaaaattcgttgatggcagctacatgcagacatatcacagttctgtacccacaggggcaaatatcccaagcccaacagactggctgaatgccctgtttggcaatgggctgagtaggtggattctgggggttataggggttctactggggggattggctctctttttcttaatcatgtctttgttcaaactgggaacgaaacaagtatttcgttcaaggacgaagctggcttag

SEQ ID NO: 4791 - RNA, 3222 nt, synthetic construct
  misc_feature 1..3222: note = derived and/or modified CDS sequence (wt) from SFTSV(SPL010A)__AB817991.1__GP
  source 1..3222: mol_type = other RNA
atgatgaaagtcatctggttctcctctctgatctgcttagtcatccaatgcagtggggatacgggcccaatcatatgcgcagggcccatccactcaaacaagagtgctaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtcttttttgaacggccaacatttgatggatacgttggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctgaagagctttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgtaggggggacatgcagttttgcaaggtggcaggttgtgaacatggggaagaggcatctgaagccaaatgcagatgctcactagtgcacaagcccggggaagttgttgtgtcatatggagggatgcgtgtcagaccaaagtgctatggtttctccagaatgatggcaacactagaggtgaactcaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaagcaatcggggtttgggggtcatgggtcatagctccagtgaagctaatgtttgccatcataaagaaactgatgagatctgtgagctgcttgatggggaaattgatggataggggaaggcaagtgatccatgaagaaataggagagaatagagagggcaaccaagatgatgttaggatcgagatggcaaggcctagaagggtaaggcactggatgtactcccctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcagtgaacccaggacaagaggcatgtctgcacttcacagcaccagggagtccggactcaaaatgtctcaaaatcaaagttaaaaggatcaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgatgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcaggggaagtgaggacattccaccccatgagcggcatccctactcaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacaatgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggcaaaatatctggtagccccttggacatcacaaccataagagggtctttttcggttaattatagaggccttcgactgagcctctcagaaattactgctacttgcacaggggaggtgacaaatgtgagtgggtgttactcttgcatgacaggcgccagggtctccatcaaactgcatagcagcaaaaatagcactgcacatgtaaggtgcaaaggggatgagactgcgttcagtgtcctggagggagttcatagctatactgtcagcctcagctttgaccatgctgtggtcgatgagcagtgccaactgaactgtggggggcatgagagtcaagtgactctaaaaggcaacctcatcttcctggatgtcccaaaattcgtagatggcagctacatgcagacatatcatagttctgtacccacaggagcaaatatcccaagcccaacagactggctgaatgccctgtttggcaatgggctgagtaggtggattctgggggtgataggggtcctactggggggattggctctctttttcttaatcatgtctttgttcaaactgggaacaaaacaggtatttcgatcaaggacgaagctggcttag

SEQ ID NO: 4792 - RNA, 3222 nt, synthetic construct
  misc_feature 1..3222: note = derived and/or modified CDS sequence (wt) from SFTSV(SPL030A)__AB817992.1__GP
  source 1..3222: mol_type = other RNA
atgatgaaagtcatctggttctcctctctgatctgcttagtcattcaatgcagtggggatacgagcccaatcatatgcgcagggcccatccactcaaacaagagtgccagcataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtcttttttgaacggccaacttttgatggatacgttggctggggctgtggcagtgggaagtcaaggactgagtcaggggagctctgcagctcagactcagggaccagttccggtcttctgccctcagatagggttctctggataggtgatgttgcttgccagcctatgacacccatccctgaagagacatttctggagctgaagagttttagccagagtgaatttccagacatatgcaaaattgatggcattgtgttcaaccagtgtgagagtgagagcctacctcagccccttgatgttgcttggatggatgttggccactctcataaaatcatcatgagggagcacaagaccaaatgggtgcaagagagctcatctaaggattttgtgtgctacaaggaagggactgggccgtgttctgaatcagaagaaaagacttgcaagaccagtggatcatgtaggggggacatgcagttttgcaaggtggcaggttgtgaacatggggaagaggcatctgaagccaagtgcagatgctcactagtgcacaagcccggggaagttgttgtgtcatatggagggatgcgtgtcagaccaaagtgctatggtttctccagaatgatggcaacactagaggtgaacccaccagagctaaggattggccaatgcaccggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctgctcaccaatgtccttaaggcaatcggggtttgggggtcatgggtcatagctccagtgaagctaatgtttgccatcataaagaaactgatgagatctgtgagctgcttgatggggaaattgatggataggggaaggcaagtaatccatgaagaaataggggagaatagagagggcaaccaagatgatgtcaggatcgagatggcaaggcctagaagggtaaggcactggatgtactcacctgtcatcctgaccattctagcaattgggcttgctgagggctgcgatgagatggtccatgcagattctaaacttgtttcgtgtaagcaagggggcggaaatatgaaggaatgtgtcacaactgggagggcgctccttcctgcggtgaacccaggacaagaggcatgtctgcacttcacagcaccagggagtccggactcaaaatgtctcaaaatcagagttaagaggatcaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcaggggaagtgaggacattccaccccatgagcggcatccctactcaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacagtgcaatagtgaggaaagtgcccgtaccataaaaaaagatgggtgtatatggaatgctgacctcgtgggcatcgagctacgagtggatgacgctgtgtgctactctaagatcactagtgtggaggcagttgcaaactactcagccatacccaccactattgggggactgaggtttgagagaagccatgacagccagggcaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccaaagtttccatcaaactgcatagcagcaaaaatagcactgcacacgtaaggtgcaaaggggatgagactgcgttcagtgtcctggagggagttcatagctatactgtcagcctcagttttgaccatgcagtggtcgatgagcagtgccagctgaactgtggggggcatgagagtcaagtgactctaaaaggcaacctcatcttcctggatgtcccaaaattcgttgatggcagctacatgcagacatatcacagttctgtacccacaggggcaaatatcccaagcccaacagactggctgaatgccctgtttggcaatgggctgagtaggtggattctgggggttataggggttctactggggggattggctctctttttcttaatcatgtctttgttcaaactgggaacgaaacaagtatttcgatcaaggacgaagctggcttag

SEQ ID NO: 4793 - RNA, 3222 nt, synthetic construct
  misc_feature 1..3222: note = derived and/or modified CDS sequence (wt) from SFTSV(SPL053A)__AB985292.1__GP
  source 1..3222: mol_type = other RNA
atgatgaaagtcatctggttctcctctctgatctgcttagtcatccaatgcagtggggatacgggcccaatcatatgcgcagggcccatccactcaaacaagggtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtcttttttgaacggccaacatttgatggatacgttggctggggctgtggcagtgggaagtcaaggactgagtcaggagagctctgcatctcagactcagggaccagttccggtcttctgccctcagatagggttctctggataggtgatgttgcttgccagcctatgacacccatccctgaagagacatttctggagctgaagagctttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgtaggggggacatgcagttttgcaaggtggcaggttgtgaacatggggaagaggcatctgaagccaaatgcagatgctcactagtgcacaagcccggggaagttgttgtgtcatatggagggatgcgtgtcagaccaaagtgctatggtttctccagaatgatggcaacactagaggtgaactcaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggcaaggcctagaagggtaaggcactggatgtactcccctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcggtgaacccaggacaagaggcatgtctgcacttcacagcaccagggagtccggactcaaaatgtctcaaaatcaaagttaagaggatcaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgatgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcaggggaagtgaggacattccaccccatgagcggcatccctactcaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacaatgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggcaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccagggtctccatcaaactgcatagcagcaaaaatagcactgcacatgtaaggtgcaaaggggatgagactgcgttcagtgtcctggagggagttcatagctatactgtcagcctcagctttgaccatgctgtggtcgatgagcagtgccaactgaactgtggggggcatgagagtcaagtgactctaaaaggcaacctcatcttcctggatgtcccaaaattcgtagatggcagctacatgcagacatatcatagctctgtacccacaggagcaaatatcccaagcccaacagactggctgaatgccctgtttggcaatgggctgagtaggtggattctgggggtgataggggttctactggggggattggctctctttttcttaatcatgtctttgttcaaactgggaacaaaacaggtatttcgatcaaggacgaagctggcttag

SEQ ID NO: 4794 - RNA, 3222 nt, synthetic construct
  misc_feature 1..3222: note = derived and/or modified CDS sequence (wt) from SFTSV(SPL054A)__AB985293.1__GP
  source 1..3222: mol_type = other RNA
atgatgaaagtcatctggttctcctctctgatctgcttagtcattcaatgcagtggggacacgggcccaatcatatgcgcagggcccatccactcaaacaagagtgccaacataccccacctgcttggttactctgagaagatttgtcagatagatcggctgatacatgtctcgtcatggttgagaaaccactcacaatttcagggctacgtggggcagcgaggtggacgctctcaggtgagttacttcccagctgaaaactcttactcaaggtggagtggacttctaagcccctgtgatgctgattggcttgggatgcttgttgtgaagaaggccaaggggtctgatatgatagttcctgggccttcatacaaggggaaagtcttttttgaacggccaacttttgatggatatgtaggctggggctgtggcagtgggaagtcaaggactgagtcaggagagctctgcagttcagactcagggaccagttcaggtcttctgccctcagatagggttctctggataggtgatgttgcttgccagcctatgacacccatccctgaagagacatttatggagctgaagagttttagccagagtgaattcccagacatatgcaaaattgatggcattgtgttcaaccagtgtgagagtgagagcctacctcaaccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacatgcaagaccagtggatcatgcaggggggacatgcagttttgcaaggtggcaggttgtgaacatggggaagaggcatctgaagccaaatgcagatgctcactagtgcacaagcccggggaagttgttgtgtcatatggagggatgcgtgtcagaccaaagtgctatggtttctcaagaatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacatgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcatcattgtcatcctccttggatatgcaggcctcatgctactcaccaatgtccttaaggcaatcggggtttgggggtcatgggtcatagctccagtgaagctaatgtttgccatcataaagaaactgatgagatctgtgagttgcctgatggggaaattgatggataggggaaggcaagtgatccatgaagaaataggggagaatggagagggcaaccaagatgatgttaggatcgagatagccaggcccagaagggtaaggcactggatgtactcacctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcggtgaacccaggacaagaggcatgtctgcacttcacggcaccagggagtccggactcaaaatgtctcaaaatcaaagttaagaggattaacctgaaatgcaagaagtcatcatcatatttcgttcctgatgctcggtccaggtgcacatctgtgaggagatgccgctgggcaggagactgtcagtctgggtgcccctctcatttcacatccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaacccacatgggatcatctggaaagtatctccatgtgctgcatgggtcccatcagcagtcatagagcttacaatgccctcaggggaagtgaggacattccaccccatgagcggcatccctacacaagtcttcaagggtgtgagtgtgacttacttgggctcagacatggaggtgtctggcttgactgacctgtgtgaaatagaagagctcaaatccaagaagctggcattagctccctgcaatcaggctggcatgggggttgtaggcaaggttggagagatacagtgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggtaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagtctcagttttgaccatgcagtggtcgatgagcagtgccagctgaactgtggaggacatgagagtcaagtgactctaaaaggcaacctcatcttcctggatgtcccaagatttgtagatggcagctacatgcaaacatatcatagttctgtgcccacaggagcaaatatcccaagccctacagactggctgaatgccctgtttggcaatgggctgagtaggtggattctgggggtgataggggttctgctgggggggttggctctctttttcttaattatgtccttgttcaaactgggaacaaaacaggtgtttcgatcaaggacgaagctggcttag

SEQ ID NO: 4795 - RNA, 3222 nt, synthetic construct
  misc_feature 1..3222: note = derived and/or modified CDS sequence (wt) from SFTSV(SPL055A)__AB985294.1__GP
  source 1..3222: mol_type = other RNA
atgatgaaagtcatctggttctcctctctgatctgcttagtcatccaatgcagtggggatacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtcttttttgaacggccaacatttgatggatacgttggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctgaagagctttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgtaggggggacatgcagttttgcaaggtggcaggttgtgaacatggggaagaggcatctgaagccaaatgcagatgctcactagtgcacaagcccggggaagttgttgtgtcatatggagggatgcgtgtcagaccaaagtgctatggtttctccagaatgatggcaacactagaggtgaactcaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgaggtggcaaggcctagaagggtaaggcactggatgtactcccctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcggtgaacccaggacaagaggcatgtctgcacttcacagcaccagggagtccggactcaaaatgtctcaaaatcaaagttaagaggatcaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgatgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcaggggaagtgaggacattccaccccatgagcggcatccctactcaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacaatgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggcaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccagggtctccatcaaactgcatagcagcaaaaatagcactgcacatgtaaggtgcaaaggggatgagactgcgttcagtgtcctggagggagttcatagctatactgtcagcctcagctttgaccatgctgtggtcgatgagcagtgccaactgaactgtggggggcatgagagtcaagtgactctaaaaggcaacctcatcttcctggatgtcccaaaattcgtagatggcagctacatgcagacatatcatagttctgtacccacaggagcaaatatcccaagcccaacagactggctgaatgccctgtttggcaatgggctgagtaggtggattctgggggtgataggggttctactggggggattggctctctttttcttaatcatgtctttgttcaaactgggaacaaaacaggtatttcgatcaaggacgaagctggcttag

SEQ ID NO: 4796 - RNA, 3222 nt, synthetic construct
  misc_feature 1..3222: note = derived and/or modified CDS sequence (wt) from SFTSV(SPL057A)__AB985295.1__GP
  source 1..3222: mol_type = other RNA
atgatgaaagtcatctggttctcctctctgatctgcttagtcattcaatgcagtggggatacgggcccaatcatatgcgcaggacccatccactcaaacaagagtgccgacataccccacctgcttggttactctgagaagatttgtcagatagatcggctgatacatgtttcgtcatggctgagaaaccattcacaatttcagggctacgtggggcagcgaggtgggcgctcacaggtaagctactacccagctgaaaactcttactcaaggtggagtggacttctaagcccctgtgatgctgattggcttgggatgcttgttgtgaagaaggccaaagggtctgatatgatagttcctgggccttcatacaaggggaaagtcttttttgaacggccaacttttgatggatacgtaggctggggctgtggcagtgggaagtcaaggactgagtcaggagagctctgcagctcagactcagggaccagttcaggtcttctgccctcagatagggttctctggataggtgatgttgcttgccagcctatgacacccatccctgaagagacattcctggagctgaagagttttagccagagtgaattcccagacatatgtagaattgatggcattgtgtttaaccagtgtgagagtgagagtctacctcaaccctttgatgttgcatggatggatgtaggccactctcataaaatcatcatgagggagcacaagaccaaatgggtgcaagagagctcttctaaggattttgtgtgctacaaggaagggactgggccgtgttctgaatcagaagaaaagacttgcaagaccagtgggtcatgcaggggggacatgcagttttgcaaggtggcaggttgtgagcatggggaagaggcatctgaagccaagtgtagatgctcactagtgcacaagcccggggaagttgttgtgtcatatggagggatgcgtgtcaggccaaagtgttatggtttctccagaatgatggcaacactagaggtgaacccaccagagcaaaggattggccaatgcactggctgccatctagagtgtgtaaatgggggtgtgaggctaatcactctaactagtgagctcaagtcagctactgtctgtgcttcccacttttgtagttctgccataagtggcaagaaaagcacagagattcaattccactcagggtcattagttgggaaaacagcaatacacgtcaaaggggctttggtggatggaactgaattcacatttgagggcagttgcatgttcccagatggttgtgacgcagtggactgcacgttctgtcgtgagtttctaaaaaatcctcagtgttaccctgcaaagaaatggttgttcatcattattgtcatcctccttggatatgcaggcctcatgctactcaccaatgtcctcaaggcaatcggggtttggggatcatgggtcatagctccagtgaagctaatgtttgccatcatgaagaaactgatgagatctgtgagctgcttgatggggaaattaatggataggggaaggcaagtgatccatgaggaaataggggagaatagagagggcaaccaagatgatgttaggatcgagatggcaagacccagaagggtgaggcattggatgtactcacctgtcatcctgactattctagcagttgggcttgctgagggctgcgatgagatggtccatgcagattctaagcttgtttcgtgcaagcaagggagcggaaatatgaaggaatgtgtcacaactgggagggcgctccttcctgcggtgaacccagggcaagaggcatgtctgcacttcacggcacctgggagtccggactcaaaatgtctcaaaattaaggttaagaagattaatctaaaatgtaagaagtcatcatcatattttgtccctgatgctcggtctaggtgtacatctgtgaggagatgtcgctgggcaggagactgccagtctgggtgcccctctcatttcacatccaactccttttctgatgattgggcaggtaaaatggacagggctggtctaggattcagtgggtgctctgatggatgtggaggagcagcctgcggctgctttaatgcagccccttcatgcatcttttggaggaaatgggtagagaatccacatgggatcatctggaaagtatctccatgtgctgcatgggttccatcagcagtcatagagctaacaatgccctcaggggaagtgaggacattccaccctatgagcggcatccccacacaggttttcaagggtgtgagtgtgacttacttaggctcagatatggaggtgtctggcttgactgacctgtgtgagatagaagagctcaagtctaagaagctggcattagccccctgcaatcaggctggtatgggggttgtaggcaaggttggagagatacagtgcagtagcgaggaaagtgcccgcaccataaaaaaagatgggtgtatatggaatgcagaccttgtgggcatagaactacgagtggatgacgctgtgtgctactctaagatcactagtgtggaggcagttgcaaactactctgccatacccaccactattggggggctgaggtttgagagaagccatgacagccagggtaagatatctggtagccccctagacatcacagccataagagggtccttttcagttaattatagaggccttcgactaagcctctcagaaattactgcaacttgcacaggagaggtgacaaatgtgagtgggtgttactcttgcatgacaggcgccaaagtctccatcaaactgcatagcaacaaaaatagcactgcccatgtaagatgcaaaggggatgagactgcgttcagcgtcctggagggagttcatagctatactgtcagtctcagctttgaccatgcagtggtcgatgagcagtgccagctgaactgtggggggcatgagagtcaagtgactctaaaaggcaatctcatctttctggatgtcccaaaatttgtagatggcagctatatgcagacatatcatagttctgtacccacaggggctaatatcccaagccctacagactggctgaatgccttgtttggcaatgggctgagtaggtggattctgggggtgataggggttctactggggggattggctctctttttcttaatcatgtctttgttcaaattgggaactaaacaggtatttcgatcaaggacgaagctggcttag

SEQ ID NO: 4797 - RNA, 3222 nt, synthetic construct
  misc_feature 1..3222: note = derived and/or modified CDS sequence (wt) from SFTSV(SPL062A)__AB985297.1__GP
  source 1..3222: mol_type = other RNA
atgatgaaagtcatctggttctcctctctgatctgcttagtcattcgatgcagtgggggcacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccagggggtctgatatgatagttcctgggccttcatacaagggaaaagtcttttttgaacggccaacttttgatggatacgtaggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctgaagagttttagccagagtgaattcccagacatatgcaaaattgatggtattgtgttcaaccagtgtgaaagtgagagcctacctcagccctttgatgttgcttggatggatgttggccactctcataaaatcatcatgagggagcacaagaccaaatgggttcaagagagctcatctaaggattttgtgtgctacaaggaagggactgggccgtgttctgaatcagaagaaaagacttgcaagaccagtggatcatgtaggggggacatgcagttttgcaaggtggcaggttgtgaacatggagaagaggcatctgaagccaaatgcagatgctcactagtgcacaagcccggggaagttgttgtgtcatatggagggatgcgtgtcagaccaaagtgctatggcttctccagaatgatggcaacactagaggtgaacccaccagagcaaaggattggccaatgcactggctgccatctagaatgcataaatgggggtgtgaggctaatcactctaactagtgagctcaagtcagctactgtctgtgcttctcacttttgtagttctgccacaagtggcaagaaaagcacggagattcaattccactcagggtctttagttgggaaaacagcaatacacgtcaaaggggcattggtggatggaactgaattcacatttgagggtagttgcatgttcccagatggttgtgacgcagtggactgcacattctgtcgtgagtttctaaaaaatcctcagtgctaccctgcaaagaaatggttgttcatcattattgccatcctccttggatatgcaggcctcatgctactcaccaatgtccttaaggcaatcggggtttgggggtcatgggtcatagctccagtaaagttaatgtttgccatcataaagaaactgatgagatctgtgagctgcttgatggggaagttgatggataggggaaggcaagtgatccatgaagagataggagagaatagagagggcaaccaagatgatgttaggatcgagatggcgaggcctagaagggtaaggcactggatgtactcacctgtcatcctgactattctagcaattgggcttgctgagggctgcgatgagatggtccatgcagattctaaacttgtttcgtgcaagcaagggagcgggaatatgaaggaatgtgtcacaactgggagggcgctccttcctgcggtgaacccaggacaagaggcatgtctgcacttcacggcaccagggagtccggactcaaaatgtctcaaaatcaaagttaagaggattaacctgaagtgcaagaagtcatcatcatatttcgtccctgatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaacccacatgggatcatctggaaagtatctccatgtgctgcatgggtcccatcagcagtcatagagcttacaatgccctcaggggaagtaaggacattccaccccatgagcggcatccctacacaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacagtgcagtagcgaggaaagtgcccgtaccataaaaaaagatgggtgtatatggaatgctgacctcgtgggcatcgagctacgagtggatgacgctgtatgctactctaagatcactagtgtggaggcagttgctaactactctgccatacccaccactattgggggtctgaggtttgagagaagccatgacagccagggtaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccaaagtctccatcaaactgcatagcagcaaaaatagcacagcacatgtaaggtgcaaaggggatgagactgcgttcagtgtcctggagggagttcatagctatactgtcagcctcagttttgaccatgcagtggtcgatgagcagtgccagctgaactgtggggggcatgagagtcaagtgactctaaaaggcaacctcatcttcctggatgtcccaaaattcgtagatggcagctacatgcagacatatcatagctctgtgcccacaggagcaaatatcccaagccctacagactggctgaatgccctgtttggcaatgggctgagtaggtggattctgggggtgataggggttctactggggggattggctctctttttcttaatcatgtctttattcaaactgggaacaaaacaggtatttcgatcaaggacgaagctggcttag

SEQ ID NO: 4798 - RNA, 3222 nt, synthetic construct
  misc_feature 1..3222: note = derived and/or modified CDS sequence (wt) from SFTSV(SPL066A)__AB985298.1__GP
  source 1..3222: mol_type = other RNA
atgatgaaagtcatctggttctcctctctgatctgcttagtcattcaatgcagtggggatgcgagcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtcttttttgaacggccaacttttgatggatacgttggctggggctgtggcagtgggaagtcaaggactgagtcaggggagctctgcagctcagactcagggaccagttccggtcttctgccctcagatagggttctctggataggtgatgttgcttgccagcctatgacacccatccctgaagagacatttctggagctgaagagttttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacatgcaagaccagtggatcatgcaggggggacatgcagttttgcaaggtggcaggttgtgaacatggggaagaggcatctgaagccaaatgcagatgctcactagtgcacaagcccggggaagttgttgtgtcatatggagggatgcgtgtcagaccaaagtgctatggtttctcaaggatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagttctgccacaagtggtaagaaaagcacggagattcaattccactcagggtcattagttgggaaagcagcaatacatgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgataagatctgtgagttgcctgatggggaaattgatggataggggaaggcaagtgatccatgaagaaataggggagaatggagagggcaaccaagatgatgttaggatcgagatggccaggcccagaagggtaaggcactggatgtactcacctgtcatcctgactattctagcaattggacttgctgagggctgcgatgagatggtccatgcagattctaaacttgtttcgtgcaagcaagggagcggaaatatgaaggaatgtgtcacaactgggagggcgctccttcctgcggtgaacccaggacaagaggcatgtctgcacttcacggcaccagggagtccggactcaaaatgtctcaaaatcaaagttaagagaattaacctgaaatgcaagaagtcatcatcatatttcgttcctgatgctcggtccaggtgcacatctgtgaggagatgccgctgggcaggagactgtcagtctgggtgcccctctcatttcacatccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcaggggaagtgaggacattccaccccatgagcggcatccctacacaaatcttcaagggtgtgagtgtgacttacttgggctcagacatggaggtgtctggcttgactgacctgtgtgaaatagaagagctcagatccaagaagctggcattagctccctgcaatcaggctggcatgggggttgtaggcaaggttggagagatacagtgcagcagcgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacctaccactattgggggactgaggtttgagagaagccatgacagccagggtaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagtctcagttttgaccatgcagtggtcgatgagcagtgccagctgaactgtggaggacatgagagtcaagtgactctaaaaggcaacctcatcttcctggatgtcccaaaattcgtagatggcagctacatgcagacatatcatagttctgtgcccacaggagcaaatatcccaagccctacagactggctgaatgccctgtttggcaatgggctgagtaggtggattctgggggtgataggggttctactggggggattggctctctttttcttaatcatgtctttgttcaaactgggaacaaaacaggtgtttcgatcaaggacgaagctggcttag

SEQ ID NO: 4799 - RNA, 3222 nt, synthetic construct
  misc_feature 1..3222: note = derived and/or modified CDS sequence (wt) from SFTSV(SPL070A)__AB985301.1__GP
  source 1..3222: mol_type = other RNA
atgatgaaagtcatctggttctcctctctgatctgcttagtcattcaatgcagtggggacacgggcccaatcatatgcgcagggcccatccattcaaacaagagtgccaacataccccacctgcttggttactctgagaagatttgtcagatagatcggctgatacatgtctcgtcatggttgagaaaccactcacaatttcagggctacgtggggcagcgaggtggacgctctcaggtgagttacttcccagctgaaaactcttactcaaggtggagtggacttctaagcccctgtgatgctgattggcttgggatgcttgttgtgaagaaggccaaggggtctgatatgatagttcctgggccttcatacaagggaaaagtcttttttgaacggccaacttttgatggatatgtaggctggggctgtggcagtgggaagtcaaggactgagtcaggagagctctgcagctcagactcagggaccagttcaggtcttctgccctcagatagggttctctggataggtgatgttgcttgccagcctatgacacccatccctgaagagacatttatggagctgaagagttttagccagagtgaattcccagacatatgcaaaattgatggcattgtgttcaaccagtgtgagagtgagagcctacctcaaccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacatgcaagaccagtggatcatgcaggggggacatgcagttttgcaaggtggcaggttgtgaacatggggaagaggcatctgaagccaaatgcagatgctcactagtgcacaagcccggggaagttgttgtgtcatatggagggatgcgtgtcagaccaaagtgctatggtttctcaagaatgatggcaacactagaggtgagcccaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacatgtcaaaggggcattgatggatgggactgaattcacatttgagggcagttgcatgttcccagatggttgtgacgcagtggactgcacattctgtcgtgagtttctaaaaaatcctcagtgctaccctgcaaagaaatggttgttcatcatcattgtcatcctccttggatatgcaggcctcatgctactcaccaatgtccttaaggcaatcggggtttgggggtcatgggtcatagctccagtgaagctaatgtttgccatcataaagaaactgatgagatctgtgagttgcctgatggggaaattgatggataggggaaggcaagtgatccatgaagaaataggggagaatggagagggcaaccaagatgatgttaggatcgagatggccaggcccagaagggtaaggcactggatgtactcacctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcggtgaacccaggacaagaggcatgtctgcacttcacggcaccagggagcccggactcaaaatgtctcaaaatcaaagttaagaggattaacctgaaatgcaagaagtcatcatcatatttcgttcctgatgctcggtccaggtgcacatctgtgaggagatgccgctgggcaggagactgtcagtctgggtgcccctctcatttcacatccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaacccacatgggatcatctggaaagtatctccatgtgctgcatgggtcccatcagcagtcatagagcttacaatgccctcaggggaagtgaggacattccaccccatgagcggcatccctacacaagtcttcaagggtgtgagtgtgacttacttgggctcagacatggaggtgactggcttgactgacctgtgtgaaatagaagagctcaaatccaagaagctggcattagctccctgcaatcaggctggcatgggggttgtaggcaaggttggagagatacagtgcagtagcgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggtaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagtctcagttttgaccatgcagtggtcgatgagcagtgccagctgaactgtggaggacatgagagtcaagtgactctaaaaggcaacctcatcttcctggatgtcccaaaatttgtagatggcagctacatgcagacatatcatagttctgtgcccacaggagcaaatatcccaagccctacagactggctgaatgccctgtttggcaatgggctgagtaggtggattctgggggtgataggggttctgctgggggggttggctctctttttcttaatcatgtccttgttcaaactgggaacaaaacaggtgtttcgaccaaggacgaagctggcttag

SEQ ID NO: 4800 - RNA, 3222 nt, synthetic construct
  misc_feature 1..3222: note = derived and/or modified CDS sequence (wt) from SFTSV(SPL071A)__AB985302.1__GP
  source 1..3222: mol_type = other RNA
atgatgaaagtcatctggttctcctctctgatctgcttaatcattcaatgcagtggggacacgggcccaatcatatgcgcagggcccatccactcaaacaagagtgccaatataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtcttttttgaacggccaacttttgatggatacgttggctggggctgtggcagtgggaagtcaaggactgagtcaggagagctctgcagctcagactcagggaccagttccggtcttctgccctctgatagggttctctggataggtgatgttgcttgccagcctatgacacccatccctgaagagacatttctggagctgaagagttttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgtaggggggacatgcagttttgcaaggtggcaggttgtgaacatggggaagagacatctgaagccaaatgcagatgctcactagtgcacaagcccggggaagttgttgtgtcatatggagggatgcgtgtcagaccaaaatgctatggtttctccagaatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggcaaggcctagaagggtaaggcactggatgtactcacctgtcatcctggctattctagcaattgggcttgctgagggctgcgatgagatggtccatgcagattctaaacttgtttcgtgcaagcaagggagcggaaatatgaaggaatgtgtcacaactgggagagcgctccttcctgcggtgaacccaggacaagaggcatgtctgcacttcacagcaccagggagtccggactcaaaatgtctcaaaatcaaagttaagaggatcaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcgggggaagtgaggacattccaccccatgagcggcatccctactcaagtcttcaagggtgtgagtgtgacttacttgggctcagatatggaggtatctggcttgactgatctgtgtgaaatagaagagctcaagtccaagaagctggcattagctccctgcaatcaggctggcatgggggttgtaggcaaggttggagagatacagtgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggcaaaatatctggtagccccttggacatcacagccataagagggtcattttcagttaactatagaggccttcggctgagcctctcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagcctcagttttgaccatgcagtggtcgatgagcagtgccagctgaactgtggggggcatgagagtcaagtgactctaaaaggcaacctcatcttcctggatgtcccaaaattcgtagatggcagctacatgcagacatatcatagttctgtacccacaggagcaaatatcccaagcccaacagactggctgaatgccctgtttggcaatgggctgagtaggtggattctgggggtgataggggttctactggggggattggctctctttttcttaatcatgtctttgttcaaactgggaacaaaacaggtatttcgatcaaggacgaagctggcttag

SEQ ID NO: 4801 - RNA, 3222 nt, synthetic construct
  misc_feature 1..3222: note = derived and/or modified CDS sequence (wt) from SFTSV(SPL077A)__AB985304.1__GP
  source 1..3222: mol_type = other RNA
atgatgaaagtcatctggttctcctctctgatctgtttagtcactcaatgcagtggggatacgggcccaataatatgcgcagggcccatccactcaaacaagagtgccaacataccccatctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaagggatctgatatgatagttcctgggccttcatacaagggaaaagtcttttttgaacggccaacttttgatggatacgtaggctggggctgtggcagtgggaagtcaaggactgagtcaggagagctctgcagctcagactcagggaccagttctggtcttctgccctcagatagggttctctggataggtgatgttgcttgccagcctatgacacccatccctgaagagacatttctggagctaaagagttttagccagagtgaattcccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaaatgcagatgctcactagtgcacaaacctggggaagttgttgtgtcatatggagggatgcgtgtcagaccaaagtgctatggtttctccaggatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacatgtcaaaggggcattggtggatggaactgaattcacatttgagggcagttgcatgttcccagatggctgtgacgcagtggactgcacattctgtcgtgagtttctaaaaaatcctcagtgctaccctgcaaagaaatggttgttcatcattattgtcatcctccttggatacgcaggcctcatgctactcaccaatgtccttaaggcaatcggggtttgggggtcatgggtcatagctccagtgaagctaatgtttgccatcctaaagaaactgatgagatctgtgagctgcttgatggggaaattgatggataggggaaggcaagtgatccatgaagaaataggagagaacagagagggcaaccaagatgatgttaggatcgagatggcaaggcctagaagggtaaggcactggatgtactcacctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcagtgaacccaggacaagaggcatgtctgcacttcacggcaccagggagtccggactcaaaatgtctcaaaatcaaagttaagaggattaacctgaaatgcaagaagtcatcatcatatttcgttcctgatgctcggtccaggtgtacatctgtgaggagatgtcgctgggctggggactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtgccatcagcagtcatagagcttacaatgccctcaggggaagtgaggacattccaccccatgagcagcatccctacacaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacagtgcagtagcgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccaccattgggggactgaggtttgagagaagccatgacagccagggtaaaatatctggtagccccttggacatcacagccataagagggtctttttcagttaattatagaggccttcgactgagcctatcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagcctcagttttgaccatgcagtggtcgatgagcagtgccagctaaactgtggggggcatgagagtcaagtgactctgaaaggcaacctcatcttcctggatgtcccaaaattcgtagatggcagctacatgcagacatatcatagttctgtgcccacaggagcaaatatcccaagccctacggactggctgaatgccctgtttggcaatgggctgagtaggtggattctgggggtgataggggttctactgggggggttggctctctttttcttaatcatgtctttgttcaaacagggaacaaaacaggtatttcgatcaaggacgaagctggcttag

SEQ ID NO: 4802 - RNA, 3222 nt, synthetic construct
  misc_feature 1..3222: note = derived and/or modified CDS sequence (wt) from SFTSV(SPL084A)__AB985307.1__GP
  source 1..3222: mol_type = other RNA
atgatgaaagtcatctggttctcctctctgatctgtttagtcattcaatgcagtggggatacgggcccaataatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactccaggtggagtggacttctaagcccctgtgatgctgattggcttgggatgcttgtcgtgaagaaggccaagggatctgatatgatagttcctgggccttcatacaagggaaaagtcttttttgaacggccaacttttgatggatacgtaggctggggctgtggcagtgggaagtcaaggactgagtcaggagagctctgcagctcagactcagggaccagttctggtcttctgccctcagatagggttctctggataggtgatgttgcttgccagcctatgacacccatccctgaagagacatttctggagctgaagagttttagccagagtgaattcccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaaatgcagatgctcactagtgcacaaacctggggaagttgttgtgtcatatggagggatgcgtgtcagaccaaagtgctatggtttctccaggatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacatgtcaaaggggcattggtggatggaactgaattcacatttgagggcagttgcatgttcccagatggctgtgacgcagtggactgcacattctgtcgtgagtttctaaaaaatcctcagtgctaccctgcaaagaaatggttgttcatcattattgtcatcctccttggatacacaggcctcatgctactcaccaatgtccttaaggcaatcggggtttgggggtcatgggtcatagctccagtgaagctaatgtttgccatcctaaagaaactgatgagatctgtgagctgcttgatggggaaattgatggataggggaaggcaagtgatccatgaagaaataggagagaacagagagggcaaccaagatgatgttaggatcgagatggcaaggcctagaagggtaaggcactggatgtactcacctgtcatcctgactattctagcaattgggcttgctgagggctgcgatgagatggtccatgcagattctaaacttgtttcgtgcaagcaagggagcggaaacatgaaggaatgtgtcacaactgggagggcgctccttcctgcagtgaacccaggacaagaggcatgtctgcacttcacggcaccagggagtccggactcaaaatgtctcaaaatcaaagttaagaggattaacctgaaatgcaagaagtcatcatcatatttcgttcctgatgctcggtccaggtgtacatctgtgaggagatgtcgctgggctggggactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcaggggaagtgagaacattccaccccatgagcggcatccctacacaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacagtgcagtagcgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggtaaaatatctggtagccccttggacatcacagccataagagggtctttttcagttaattatagaggccttcgactgagcctatcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtccaggagggagttcatagctatactgtcagcctcagttttgaccatgcagtggtcgatgagcagtgccagctaaactgtggggggcatgagagtcaagtgactctgaaaggcaacctcatcttcctggatgtcccaaaattcgtagatggcagctacatgcagacatatcatagttctgtgcccacaggagcaaatatcccaagccctacggactggctgaatgccctgtttggcaatgggctgagtaggtggattctgggggtgataggggttctactggggggattggctctctttttcttaatcatgtctttgttcaaactgggaacaaaacaggtatttcgatcaaggacgaagctggcttag

SEQ ID NO: 4803 - RNA, 3222 nt, synthetic construct
  misc_feature 1..3222: note = derived and/or modified CDS sequence (wt) from SFTSV(SPL086A)__AB985308.1__GP
  source 1..3222: mol_type = other RNA
atgatgaaagtcatctggttctcctctctgatctgcttagtcatccaatgcagtggggatacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtcttttttgaacggccaacatttgatggatacgttggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctgaagagctttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaggagagctcatctaaggattttgtgtgctacaaggaagggactgggccgtgttctgaatcagaagaaaagacttgcaagaccagtggatcatgtaggggggacatgcagttttgcaaggtggcaggttgtgaacatggggaagaggcatctgaagccaaatgcagatgctcactagtgcacaagcccggggaagttgttgtgtcatatggagggatgcgtgtcagaccaaagtgctatggtttctccagaatgatggcaacactagaggtgaacccaccagagcaaaggattggccaatgcactggctgccatctagaatgcataaatgggggtgtgagactaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggcaaggcctagaagggtaaggcactggatgtactcccctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcggtgaacccaggacaagaggcatgtctgcacttcacagcaccagggagtccggactcaaaatgtctcaaaatcaaagttaagaggatcaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgatgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcaggggaagtgaggacattccaccccatgagcggcatccctactcaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacaatgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggcaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccagggtctccatcaaactgcatagcagcaaaaatagcactgcacatgtaaggtgcaaaggggatgagactgcgttcagtgtcctggagggagttcatagctatactgtcagcctcagctttgaccatgctgtggtcgatgagcagtgccaactgaactgtggggggcatgagagtcaagtgactctaaaaggcaacctcatcttcctggatgtcccaaaattcgtagatggcagctacatgcagacatatcatagttctgtacccacaggagcaaatatcccaagcccaacagactggctgaatgccctgtttggcaatgggctgagtaggtggattctgggggtgataggggttctactggggggattggctctctttttcttaatcatgtctttgttcaaactgggaacaaaacaggtatttcgatcaaggacgaagctggcttag

SEQ ID NO: 4804 - RNA, 3222 nt, synthetic construct
  misc_feature 1..3222: note = derived and/or modified CDS sequence (wt) from SFTSV(SPL087A)__AB985309.1__GP
  source 1..3222: mol_type = other RNA
atgatgaaagtcatctggttctcctctctgatctgcttagtcattcaatgcagtggggactcgggcccaatcatctgtgcaggacccatccactcaaacaagagtgctgacataccacacctgcttggttactctgagaagatctgtcagatagatcggctgattcatgtatcgtcatggctcaggaaccactcacaatttcagggctacgtagggcagcgaggtggtcgctctcaggtgagctactacccggctgaaaattcttactcaaggtggagtggacttctaagtccctgtgatgctgattggcttgggatgcttgtcgtgaagaaggccaaggggtctgacatgatagtccctgggccttcatacaagggaaaagtcttttttgaacggccaacttttgatgggtatgtaggatggggctgtggcagtgggaagtctaggtctgagtcaggagagctctgcagttcagactcagggactagttctggtcttctgccctcggatagggttctctggataggtgatgttgcttgtcagcctatgacacccatccctgaggagacatttctggagctgaagagctttagccaaagtgaattcccagacatatgcaaaattgatggcattgtgttcaaccagtgtgagggtgagagtctacctcagccctttgatgttgcatggatggatgttggccactcacataagatcatcatgagggagcacaaaaccaaatgggtacaagagagctcatccaaggatttcgtgtgttacaaggaagggactgggccttgttctgaatctgaagaaaagacttgcaagaccagtggatcatgcaggggggacacacagttttgcaaggtggcaggttgtgaacatggggaagaggcatctgaagccaagtgtagatgctcacttgtgcacaagcccggggaagttgttgtgtcatatggagggatgcgtgtcagaccaaagtgctatggtttctccagaatgatggcaacactagaggtgagcccaccagagcaaaggattggtcaatgcactggctgccatctagaatgcatcaatgggggtgtgaggctaatcactctaaccagtgagcttaagtcagcaactgtctgtgcttcccacttttgcagttctgccacaagtggtaagaaaagcacagagattcaattccactcaggatcattggttgggaaaacagcaatacacgtcaaaggggcattggtagatggaactgaattcacatttgagggtagttgcatgttcccagatggttgtgatgcagtggactgcacattctgtcgtgagtttctaaaaaatcctcagtgctaccctgcaaagaagtggctgttcatcatcattgtcatcctacttgggtatgcaggcctcatgctactcaccaatgtcctcaaggcaattggggtttggggatcatgggtcatagctccagtgaagctaatgtttgccatcataaagaaactaatgagaactgtgagctgcttgatggggaaattgatggacaggggaaggcaggtgatccatgaggaaataggggagaatagagagggaaaccgagatgatattagaatcgagatggcaaggcccagaagggtaaggcattggatgtactcacctgtcatcctaactattctagctatagggcttgctgagggctgtgatgagatggtccatgctgattccaagcttgtttcatgcaggcaagggagcggaaatatgaaggaatgtgtcacaactgggagggcgcttcttcccgcagtgaacccaggacaagaggcgtgtctgcacttcacggcacctgggagtccagactcaaaatgcctcaaaattaaagttaagaggatcaacctaaaatgtaagaagtcatcatcatattttgttcctgatgcccggtccaggtgtacatcagtgaggagatgtcgttgggcaggagactgccaatctgggtgcccccctcatttcacatccaactccttttctgatgactgggcaggtaagatggacagggctggtctaggattcagtggctgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagctaacaatgccctcaggggaagtgaggacattccaccccatgagcggcatccccacacaggtcttcaagggtgtgagtgttacttacttgggctcagatatggaggtgtctggcttgactgacctgtgtgagatagaagagctcaagtccaagaagctggcactagctccctgcaaccaggctggcatgggggttgtaggcaaggttggagagatacagtgcagcagcgaggaaagtgcccgtaccataaagaaagatgggtgcatatggaatgctgacctcgtgggtattgagctacgagtggatgacgcagtgtgctactctaagatcactagtgtggaggcagttgcaaactactctgccatacccaccactattggggggctgaggtttgagaggagccatgacagccaaggtaaaatatctggtagccccctggacatcacagctataagagggtcgttttctgttaattatagaggccttcgactgagtctctcagaaattactgctacctgcacaggggaggtgacaaatgtgagtgggtgttattcttgcatgacgggcgccaaagtctccatcaaattgcatagcagcaaaaatagtactgcccatgtaagatgcaaaggggatgagacagcattcagtgtcttagagggagtccatagctacactgtcagtctcagttttgaccatgcggtggtcgatgagcggtgccagttgaactgtggggggcatgagagtcaagtgactctaaaaggcaacctcatcttcctggatgtcccaaaatttgtggatggtagctacatgcaaacatatcacagtactgtgcccacaggggcaaatattccaagcccaacagattggctgaatgccttgtttggcaatgggctgagtaggtggatcctaggggtgataggggttctactggggggattggctctctttttcttaatcatgtctttgttcaagctgggaacaaaacaggtatttcgatcgaggacgaagctggcttag

SEQ ID NO: 4805 - RNA, 3222 nt, synthetic construct
  misc_feature 1..3222: note = derived and/or modified CDS sequence (wt) from SFTSV(SPL090A)__AB985311.1__GP
  source 1..3222: mol_type = other RNA
atgatgaaagtcatctggttcccctctctgatctgcttagtcattcgatgcagtgggggcacgggcccaatcatatgcgcagggcccatccactcaaacaagagtgccaacataccccacctgcttggttactctgagaagatttgtcagatagatcggctgatacatgtttcgtcatggttgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccagggggtctgatatgatagttcctgggccttcatacaagggaaaagtcttttttgaacggccaacttttgatggatacgtaggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctgaagagttttagccagagtgaattcccagacatatgcaaaattgatggtattgtgttcaaccagtgtgaaagtgagagcctacctcagccctttgatgttgcttggatggatgttggccactctcataaaatcatcatgagggagcacaagaccaaatgggttcaagagagctcatccaaggactttgtgtgctacaaggaagggactgggccgtgttctgaatcagaagaaaagacttgcaagaccagtggatcatgtaggggggacatgcagttttgcaaggtggcaggttgtgaacatggagaagaggcatctgaagccaaatgcagatgctcactagtgcacaagcccggggaagttgttgtgtcatatggagggatgcgtgtcagaccaaagtgctatggcttctccagaatgatggcaacactagaggtgaacccaccagagcaaaggattggccaatgcactggctgccatctagaatgcataaatgggggtgtgaggctaatcactctaactagtgagctcaagtcagctactgtctgtgcttctcacttttgtagttctgccacaagtggcaagaaaagcacggagattcaattccactcagggtctttagttgggaaaacagcaatacacgtcaaaggggcattggtggatggaactgaattcacatttgagggtagttgcatgttcccagatggttgtgacgcagtggactgcacattctgtcgtgagtttctaaaaaatcctcagtgctaccctgcaaagaaatggttgttcatcattattgccatcctccttggatatgcaggcctcatgctactcaccaatgtccttaaggcaatcggggtttgggggtcatgggtcatagctccagtaaagttaatgtttgccatcataaagaaactgatgagatctgtgagctgcttgatggggaagttgatggataggggaaggcaagtgatccatgaagagataggagagaatagagagggcaaccaagatgatgttaggatcgagatggcgaggcctagaagggtaaggcactggatgtactcacctgtcatcctgactattctagcaattgggcttgctgagggctgcgatgagatggtccatgcagattctaaacttgtttcgtgcaagcaagggagcgggaatatgaaggaatgtgtcacaactgggagggcgctccttcctgcggtgaacccaggacaagaggcatgtctgcacttcacggcaccagggagtccggactcaaaatgtctcaaaatcaaagttaagaggattaacctgaaatgcaagaagtcatcatcatattttgtccctgatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaacccacatgggatcatctggaaagtatctccatgtgctgcatgggtcccatcagcagtcatagagcttacaatgccctcaggggaagtgaggacattccaccccatgagcggcatccctacacaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacagtgcagtagcgaggaaagtgcccgtaccataaaaaaagatgggtgtatatggaatgctgacctcgtgggcatcgagctacgagtggatgacgctgtatgctactctaagatcactagtgtggaggcagttgctaactactctgccatacccaccactattgggggtctgaggtttgagagaagccatgacagccagggtaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagcctcagttttgaccatgcagtggtcgatgagcagtgccagctgaactgtgggggacatgagagtcaagtgactctaaaaggcaacctcatcttcctggatgtcccaaaattcgtagatggcagctacatgcagacatatcatagctctgtgcccacaggagcaaatatcccaagccctacagactggctgaatgccctgtttggcaatgggctgagtaggtggattctgggggtgataggggttctactggggggattggctctctttttcttaatcatgtctttattcaaactgggaacaaaacaggtatttcgatcaaggacgaagctggcttag

SEQ ID NO: 4806 - RNA, 3222 nt, synthetic construct
  misc_feature 1..3222: note = derived and/or modified CDS sequence (wt) from SFTSV(SPL097A)__AB985312.1__GP
  source 1..3222: mol_type = other RNA
atgatgaaagtcatctggttctcctctctgatctgcttagtcattcaatgcagtggggatacgggcccaatcatatgcgcaggacccatccactcaaacaagagtgccgacataccccacctgcttggttactctgagaagatttgtcagatagatcggctgatacatgtttcgtcatggctgagaaaccattcacaatttcagggctacgtggggcagcgaggtgggcgctcacaggtaagctactacccagctgaaaactcttactcaaggtggagtggacttctaagcccctgtgatgctgattggcttgggatgcttgttgtgaagaaggccaaagggtctgatatgatagttcctgggccttcatacaaggggaaagtcttttttgaacggccaacttttgatggatacgtaggctggggctgtggcagtgggaagtcaaggactgagtcaggagagctctgcagctcagactcagggaccagttcaggtcttctgccctcagatagggttctctggataggtgatgttgcttgccagcccatgacacccatccctgaagagacatttctggagctgaagagttttagccagagcgaattcccagacatatgcaaaattgatggcattgtgtttaaccagtgcgagagtgagagtctacctcaaccctttgatgttgcatggatggatgtaggccactctcataaaatcatcatgagggagcacaagaccaaatgggtgcaagagagctcttctaaggattttgtgtgctacaagcaagggactgggccgtgtcctgaatcagaagaaaagacttgcaagaccagtgggtcatgcaggggggacatgcagttttgcaaggtggcaggttgtgagcatggggaagaggcatctgaagccaagtgtagatgctcactagtgcacaagcccggggaagttgttgtgtcatatggagggatgcgtgtcaggccaaagtgttatggtttctccagaatgatggcaacactagaggtgaacccaccagagcaaaggattggccaatgcactggctgccatctagaatgtgtaaatgggggtgtgaggctaatcactctaactagtgagctcaagtcagctactgtctgtgcttcccacttttgtagttctgccacaagtggcaagaaaaacacagagattcaattccactcagggtcattagttgggaaaacagcaatacacgtcaaaggggctttgttggatggaactgaattcacatttgagggcagttgcatgttcccagatggttgtgacgcagtggactgcacgttctgtcgtgagtttctaaaaaatcctcagtgctaccctgcaaagaaatggttgttcatcattattgtcatcctccttggatatgcaggcctcatgctactcaccaatgtccttaaggcaatcggggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggcaagacctagaagggtaaggcattggatgtactcacctgtcatcctgactattctagcagttgggcttgctgagggctgcgatgagatggtccatgcagattctaagcttgtttcgtgcaagcaagggagcggaaatatgaaggaatgtgtcacaactgggagggcgctccttcctgcggtaaacccagggcaagaggcatgtctgcacttcacggcacctgggagtccggactcaaaatgtctcaaaattaaggttaagaagattaatctaaaatgtaagaagtcatcatcatattttgtccctgatgctcggtctaggtgtacatctgtgaggagatgtcgctgggcaggagactgccagtctgggtgcccctctcatttcacgtccaactccttttctgatgattgggcaggtaaaatggacagggctggtctaggattcagtgggtgctctgatggatgtggaggagcagcctgcggctgctttaatgcagccccttcatgcatcttttggaggaaatgggtagagaacccacatgggatcatctggaaagtatctccatgtgctgcatgggtcccatcagcagtcatagagctaacaatgccctcaggggaagtgaggacattccaccccatgagcggcatccctacacaggtcttcaagggtgtgagtgtgacttacttaggctcagatatggaggtgtctggcttgactgacctgtgtgagatagaagagctcaagtctaagaaactggcattagccccctgcaatcaggctggcatgggggttgtaggcaaggttggagagatacagtgcagtagcgaggaaagtgcccgcaccataaaaaaagatgggtgtatatggaatgctgaccttgtgggcatagaactacgagtggatgacgctgtgtgctactctaagatcactagtgtggaggcagttgcaaactactctgccatacccaccactattggggggctgaggtttgagagaagccatgacagccagggtaagatatctggtagccccctagacatcacagccataagagggtccttttcagttaattatagaggccttcgactaagcctctcagaaattactgcaacatgcacaggagaggtgacaaatgtgagtgggtgttactcttgcatgacaggcgccaaagtctccatcaaactgcatagcaacaaaaatagcactgcccatgtaaggtgcaaaggggatgagactgcgttcagcgtcctggagggagttcatagctatactgtcagtctcagctttgaccatgcagtggtcgatgagcagtgccagctgaactgtggggggcatgagagtcaagtgactctaaaaggcaacctcatctttctggatgtcccaaagtttgtagatggcagctatatgcagacatatcatagttctgtacccacaggggctaatatcccaagccctacagactggctgaatgccttgtttggcaatgggctgagtaggtggattctgggggtgataggggttctactggggggattggctctctttttcttaatcatgtctctgttcaaattgggaactaaacaggtatttcgatcaaggacgaagctggcctag

SEQ ID NO: 4807 - RNA, 3222 nt, synthetic construct
  misc_feature 1..3222: note = derived and/or modified CDS sequence (wt) from SFTSV(SPL100A)__AB985313.1__GP
  source 1..3222: mol_type = other RNA
atgatgaaagtcatctggttctcctctctgatctgcttagtcattcaatgcagtggggatacgggcccaatcatatgcgcaggacccatccactcaaacaagagtgccgacataccccacctgcttggttactctgagaagatttgtcagatagatcggctgatacatgtttcgtcatggctgagaaaccattcacaatttcagggctacgtggggcagcgaggtgggcgctcacaggtaagctactacccagccgaaaactcttactcaaggtggagtggacttctaagcccctgtgatgctgattggcttgggatgcttgttgtgaagaaggccaaagggtctgatatgatagttcctgggccttcatacaagggaaaagtcttttttgaacggccaacttttgatggatacgtaggctggggctgtggcagtgggaagtcaaggactgagtcaggagagctctgcagctcagactcagggaccagttcaggtcttctgccctcagatagggttctctggataggtgatgttgcttgccagcctatgacacccatccctgaagagacatttctggagctgaagagtttcagccagagcgaattcccagacatatgcaaaattgatggcattgtgtttaaccagtgcgagagtgagagtctacctcaaccctttgatgttgcatggatggatgtaggccactctcataaaatcatcatgagggagcacaagaccaaatgggtgcaagagagctcttctaaggattttgtgtgctacaagcaagggactgggccgtgttctgaatcagaagaaaagacttgcaagaccagtgggtcatgcaggggggacatgcagttttgcaaggtggcaggttgtgagcatggggaagaggcatctgaagccaagtgtagatgctcactagtgcacaagcccggggaagttgttgtgtcatatggagggatgcgtgtcaggccaaagtgttatggtttctccagaatgatggcaacactagaggtgaacccaccagagcaaaggattggccagtgcactggctgccatctagaatgtgtaaatgggggtgtgaggctaatcactctaactagtgagctcaagtcagctactgtctgtgcttcccacttttgtagttctgccacaagtggcaagaaaagcacagagattcaattccactcagggtcattagttgggaaaacagcaatacacgtcaaaggggctttgttggatggaactgaattcacatttgagggcagttgcatgttcccagatggttgtgacgcagtggactgcacgttctgtcgtgagtttctaaaaaatcctcagtgctaccctgcaaagaaatggttgttcatcattattgtcatcctccttggatatgcaggcctcatgctactcaccaatgtccttaaggcaatcgcggtttggggatcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggcaagacctagaagggtaaggcattggatgtactcacctgtcatcctgactgttctagcagttgggcttgctgagggctgcgatgagatggtccatgcagattctaagcttgtttcgtgcaagcaagggagcggaaatatgaaggaatgtgtcacaactgggagggcgctccttcctgcggtaaacccagggcaagaggcatgtctgcacttcacggcacctgggagtccggactcaaaatgtctcaaaattaaggttaagaagattaatctaaaatgtaagaagtcatcatcatattttgtccctgatgctcggtctaggtgtacatctgtgaggagatgtcgctgggcaggagactgccagtctgggtgcccctctcatttcacgtccaactccttttctgatgattgggcaggtaaaatggacagggctggtctaggattcagtgggtgctctgatggatgtggaggagcagcctgcggctgctttaatgcagccccttcatgcatcttttggaggaaatgggtagagaacccacatgggatcatctggaaagtatctccatgtgctgcatgggtcccatcagcagtcatagagctaacaatgccctcaggggaagtgaggacattccaccccatgagcggcatccctacacaggtcttcaagggtgtgagtgtgacttacttaggctcagatatggaggtgtctggcttgactgacctgtgtgagatagaagagctcaagtctaagaaactggcattagccccctgcaatcaggctggtatgggggttgtaggcaaggttggagagatacagtgcagtagcgaggaaagtgcccgcaccataaaaaaagatgggtgtatatggaatgctgaccttgtgggcatagaactacgagtggatgacgctgtgtgctactctaagatcactagtgtggaggcagttgcaaactactctgccatacccaccactattggggggctgaggtttgagagaagccatgacagccagggtaagatatctggtagccccctagacatcacagccataagagggtccttttcagttaattatagaggccttcgactaagcctctcagaaattactgcaacttgcacaggagaggtgacaaatgtgagtgggtgttactcttgcatgacaggcgccaaagtctccatcaaactgcatagcaacaaaaatagcactgcccatgtaaggtgcaaaggggatgagactgcgttcagcgtcctggagggagttcatagctatactgtcagtctcagctttgaccatgcagtggtcgatgagcagtgccagctgaactgtggggggcatgagagtcaagtgactctaaaaggcaacctcatctttctggatgtcccaaagtttgtagatggcagctatatgcagacatatcatagttctgtacccacaggggctaatatcccaagccctacagactggctgaatgccttgtttggcaatgggctgagtaggtggattctgggggtgataggggttctactggggggattggctctctttttcttaatcatgtctttgttcaaattgggaactaaacaggtatttcgatcaaggacgaagctggcttag

SEQ ID NO: 4808 - RNA, 3222 nt, synthetic construct
  misc_feature 1..3222: note = derived and/or modified CDS sequence (wt) from SFTSV(SPL106A)__AB985316.1__GP
  source 1..3222: mol_type = other RNA
atgatgaaagtcatctggttctcctctctgatctgtttagtcattcaatgcagtggggatacgggcccaataatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaagggatctgatatgatagttcctgggccttcatacaagggaaaagtcttttttgaacggccaacttttgatggatacgtaggctggggctgtggcagtgggaagtcaaggactgagtcaggagagctctgcagctcagactcagggaccagttctggtcttctgccctcagatagggttctctggataggtgatgttgcttgccagcctatgacacccatccctgaagagacatttctggagctaaagagttttagccagagtgaattcccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaaatgcagatgctcactagtgcacaaacctggggaagttgttgtgtcatatggagggatgcgtgtcagaccaaagtgctatggtttctccaggatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacatgtcaaaggggcattggtggatggaactgaattcacatttgagggcagttgcatgttcccagatggctgtgacgcagtggactgcacattctgtcgtgagtttctaaaaaatcctcagtgctaccctgcaaagaaatggttgttcatcattattgtcatcctccttggatacgcaggcctcatgctactcaccaatgtccttaaggcaatcggggtttgggggtcatgggtcatagctccagtgaagctaatgtttgccatcctaaagaaactgatgagatctgtgagctgcttgatggggaaattgatggataggggaaggcaagtgatccatgaagaaataggagagaacagagagggcaaccaagatgatgttaggatcgagatggcaaggcctagaagggtaaggcactggatgtactcacctgtcatcctgactattctagcaattgggcttgctgagggctgcgatgaggtggtccatgcagattctaaacttgtttcgtgcaagcaagggagcggaaatatgaaggaatgtgtcacaactgggagggcgctccttcctgcagtgaacccaggacaagaggcatgtctgcacttcacggcaccagggagtccggactcaaaatgtctcaaaatcaaagttaagaggattaacctgaaatgcaagaagtcatcatcatatttcgttcctgatgctcggtccaggtgtacatctgtgaggagatgtcgctgggctggggactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaacccacatgggatcatctggaaagtatctccatgtgctgcatgggtcccatcagcagtcatagagcttacaatgccctcaggggaagtgaggacattccaccccatgagcggcatccctacacaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacagtgcagtagcgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggtaaaatatctggtagccccttggacatcacagccataagagggtctttttcagttaattatagaggccttcgactgagcctatcagaaattactgctacttgcacaggggaggtgacaaatgtgagtgggtgttactcttgcatgataggcgccaaagtctccatcaaactgcatagcagcaaaaatagcactgcacatgtaaggtgcaaaggggatgagactgcgttcagtgtcctggagggagttcatagctatactgtcagcctcagttttgaccatgcagtggtcgatgagcagtgccagctaaactgtggggggcatgagagtcaagtgactctgaaaggcaacctcatcttcctggatgtcccaaaattcgtagatggcagctacatgcagacatatcatagttctgtgcccacaggagcaaatatcccaagccctacggactggctgaatgccctgtttggcaatgggctgagtaggtggattctgggggtgataggggtcctactggggggattggctctcttttccttaatcatgtctttgttcaaactgggaacaaaacaggtacttcgatcaaggacgaagctggcttag

SEQ ID NO: 4809 - RNA, 3222 nt, synthetic construct
  misc_feature 1..3222: note = derived and/or modified CDS sequence (wt) from SFTSV(SPL117A)__AB985321.1__GP
  source 1..3222: mol_type = other RNA
atgatgaaagtcatctggttctcctctctgatctgcttagtcattcaatgcagtggggatacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaagggatctgatatgatagttcctgggccttcatacaggggaaaagtcttttttgaacggccaacttttgatggatacgtaggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctaaagagctttagccagagtgaattcccagacatatgcaaaattgatggcattgtgttcaaccagtgtgagagtgagagcctacctcagccctttgatgttgcttggatggatgttggccactctcataaaatcatcatgagggagcacaagaccaaatgggtgcaagagagctcatctaaggattttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaaatgcagatgctcactagtgcacaagcctggggaagttgttgtgtcatatggagggatgcgtgtcagaccaaagtgctatggtttctccaggatgatggcaacactagaggtgaacccaccagagcaaaggattggccaatgcactggctgccatctagaatgcataaatgggggtgtgaggctaatcactctaaccagtgagctcaagtcagctactgtctgtgcttcccacttttgtagttctgccacaagtggcaagaaaagcacggagattcaattccactcagggtcattagttgggaaaacagcaatacatgtcaaaggggcattggtggatggaactgaattcacatttgagggcagttgcatgttcccagatggctgtgacgcagtggactgcacattctgtcgtgagtttctaaaaaatcctcagtgctaccctgcaaagaaatggttgttcatcattattgtcatcctccttggatatgcaggcctcatgctgctcaccaatgtccttaaggcaatcggggtttgggggtcatgggtcatagctccagtgaagctaatgtttgccatcataaagaaactgatgagatctgtgagctgcttgatggggaaattgatggataggggaaggcaagtgatccatgaagaaataggagagaacagagagggcaaccaagatgatgttaggatcgagatggcaaggcctagaagggtaaggcactggatgtactcacctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcagtgaacccaggacaagaggcatgtctgcacttcacggcaccagggagtccggactcaaaatgtctcaaaatcaaagttaagaggattaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtggagaatccacatgggatcatctggaaagtatctccatgtgctgcatgggtcccatcagcagtcatagagcttacaatgccctcaggggaagtgaggacattccaccccatgagcggcatccctacacaagtcttcaaaggtgtgagtgtgacttacttgggctcagatatggaggtatctggcttgactgacctctgtgaaatagaagagctcaagtccaagaagctggcattagctccctgcaatcaggctggcatgggggttgtaggcaaggttggagagatacagtgcagtagcgaggaaagtgcccgtaccataaaaaaagatgggtgtatatggaatgctgacctagtgggcatcgagctacgagtggatgacgctgtgtgctactctaagatcactagtgtggaggcagttgcaaactactctgccatacccaccactattgggggactgaggtttgagagaagccatgacagccagggtaaaatatctggtagccccttggacatcacagccataagagggtctttttcagttaattatagaggccttcgactgagcctatcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagcctcagctttgaccatgcagtggtcgatgagcagtgccagctaaactgtggggggcatgagagtcaagtgactctgaaaggaaacctcatcttcctggatgtcccaaaattcgtagatggcagctacatgcagacatatcatagttctgtgcccacaggagcaaatatcccaagccctacagactggctgaatgccctgtttggcaatgggctgagtaggtggattctgggggtgataggggttctactggggggattggccctctttttcttaatcatgtctttgttcaaactgggaacaaaacaggtatttcgatcaaggacgaagctggcttag

SEQ ID NO: 4810 - RNA, 3222 nt, synthetic construct
  misc_feature 1..3222: note = derived and/or modified CDS sequence (wt) from SFTSV(SPL120A)__AB985322.1__GP
  source 1..3222: mol_type = other RNA
atgatgaaagtcatctggttctcctctctgatctgtttagtcattcaatgcagtggggatacgggcccaataatatgcgcagggcccatccactcaaacaagagtgccaacataccccacctgcttggttactctgagaagatctgtcagatagatcggctgatacatgtttcgtcatggctgagaaaccattcacaatttcagggctacgtggggcagcgaggtggacgctctcaggtgagttacttcccagctgaaaactcttactcaaggtggagtgggcttctaagcccctgtgatgctgattggcttgggatgcttgtcgtgaagaaggccaagggatctgatatgatagttcctgggccttcatacaagggaaaagtcttttttgaacggccaacttttgatggatacgtaggctggggctgtggcagtgggaagtcaaggactgagtcaggagagctctgcagctcagactcagggaccagttctggtcttctgccctcagatagggttctctggataggtgatgttgcttgccagcctatgacacccatccctgaagagacatttctggagctaaagagttttagccagagtgaattcccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgcaggggggacatgcagttttgcaaggtggcaggttgtgaacatggggaagaggcatctgaagccaaatgcagatgctcactagtgcacaaacctggggaagttgttgtgtcatatggagggatgcgtgtcagaccaaagtgctatggtttctccaggatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacatgtcaaaggggcattggtggatggaactgaattcacatttgagggcagttgcatgttcccagatggctgtgacgcagtggactgcacattctgtcgtgagtttctaaaaaatcctcagtgctaccctgcaaagaaatggttgttcatcattattgtcatcctccttggatacgcaggcctcatgctactcaccaatgtccttaaggcaatcggggtttgggggtcatgggtcatagctccagtgaagctaatgtttgccatcctaaagaaactgatgagatctgtgagctgcttgatggggaaattgatggataggggaaggcaagtgatccatgaagaaataggagagaacagagagggcaaccaagatgatgttaggatcgagatggcaaggcctagaagggtaaggcactggatgtactcacctgtcatcctgactattctagcaattgggcttgctgagggctgcgatgaggtggtccatgcagattctaaacttgtttcgtgcaagcaagggagcggaaatatgaaggaatgtgtcacaactgggagggcgctccttcctgcagtgaacccaggacaagaggcatgtctgcacttcacggcaccagggagtccggactcaaaatgtctcaaaatcaaagttaagaggattaacctgaaatgcaagaagtcatcatcatatttcgttcctgatgctcggtccaggtgtacatctgtgaggagatgtcgctgggctggggactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaacccacatgggatcatctggaaagtatctccatgtgctgcatgggtcccatcagcagtcatagagcttacaatgccctcaggggaagtgaggacattccaccccatgagcggcatccctacacaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacagtgcagtagcgaggaaagtgcccgtaccataaaaaaagatgggtgtatatggaatgctgacctcgtgggcatcgagctacgagtggatgatgctgtgtgctactctaagatcactagtgtggaggcagttgcaaactactctgccatacccaccactattgggggactgaggtttgagagaagccatgacagccagggtaaaatatctggtagccccttggacatcacagccataagagggtctttttcagttaattatagaggccttcgactgagcctatcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagcctcagttttgaccatgcagtggtcgatgagcagtgccagctaaactgtggggggcatgagagtcaagtgactctgaaaggcaacctcatcttcctggatgtcccaaaattcgtagatggcagctacatgcagacatatcatagttctgtgcccacaggagcaaatatcccaagccctacggactggctgaatgccctgtttggcaatgggctgagtaggtggattctgggggtgataggggttctactggggggattggctctcttttccttaatcatgtctttgttcaaactgggaacaaaacaggtatttcgatcaaggacgaagctggcttag

SEQ ID NO: 4811 - RNA, 3222 nt, synthetic construct
  misc_feature 1..3222: note = derived and/or modified CDS sequence (wt) from SFTSV(SPL121A)__AB985323.1__GP
  source 1..3222: mol_type = other RNA
atgatgaaagtcatctggttctcctctctgatctgcttagtcatccaatgcagtggggatacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtcttttttgaacggccaacatttgatggatacgttggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctgaagagctttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcacctaaggattttgtgtgctacaaggaagggactgggccgtgttctgaatcagaagaaaagacttgcaagaccagtggatcatgtaggggggacatgcagttttgcaaggtggcaggttgtgaacatggggaagaggcatctgaagccaaatgcagatgctcactagtgcacaagcccggggaagttgttgtgtcatatggagggatgcgtgtcagaccaaagtgctatggtttctccagaatgatggcaacactagaggtgaactcaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggcaaggcctagaagggtaaggcactggatgtactcccctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcggtgaacccaggacaagaggcatgtctgcacttcacagcaccagggagtccggactcaaaatgtctcaaagtcaaagttaagaggatcaacctgaaatgcaagaagtcatcatcatatttcgttcctgatgctcggtccaggtgtacatctgtgaggagatgccgctgggcaggagactgtcagtctgggtgcccctcccatttcacgtccaactccttttctgatgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcaggggaagtgaggacattccaccccatgagcggcatccctactcaagtcttcaagggtgtgagtgtgacttacttgggctcagatatggaggtatctggcttgactgacctgtgtgaaatggaagagctcaagtccaagaagctggcattagctccctgcaatcaggctggcatgggggttgttggcaaggttggagagatacaatgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggcaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccagggtctccatcaaactgcatagcagcaaaaatagcactgcacatgtaaggtgcaaaggggatgagactgcgttcagtgtcctggagggagttcatagctatactgtcagcctcagctttgaccatgctgtggtcgatgagcagtgccaactgaactgtggggggcatgagagtcaagtgactctaaaaggcaacctcatcttcctggatgtcccaaaattcgtagatggcagctacatgcagacatatcatagttctgtacccacaggagcaaatatcccaagcccaacagactggctgaatgccctgtttggcaatgggctgagtaggtggattctgggggtgataggggttctactggggggattggctctctttttcttaatcatgtctttgttcaaactgggaacaaaacaggtatttcgatcaaggacgaagctggcttag

SEQ ID NO: 4812 - RNA, 3222 nt, synthetic construct
  misc_feature 1..3222: note = derived and/or modified CDS sequence (wt) from SFTSV(SPL124A)__AB985324.1__GP
  source 1..3222: mol_type = other RNA
atgatgaaagtcatctggttctcctctctgatctgcttagtcatccaatgcagtggggatacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtcttttttgaacggccaacatttgatggatacgttggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctgaagagctttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgtaggggggacatgcagttttgcaaggtggcaggttgtgaacatggggaagaggcatctgaagccaaatgcagatgctcactagtgcacaagcccggggaagttgttgtgtcatatggagggatgcgtgtcagaccaaagtgctatggtttctccagaatgatggcaacactagaggtgaactcaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggcaaggcctagaagggtaaggcactggatgtactcccctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcggtgaacccaggacaagaggcatgtctgcacttcacagcaccagggagtccggactcaaaatgtctcaaaatcagagttaagaggatcaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgatgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgccgcatgggtcccatcagcagtcatagagcttacaatgccctcaggggaagtgaggacattccaccccatgagcggcatccctactcaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacaatgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggcaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccagggtctccatcaaactgcatagcagcaaaaatagcactgcacatgtaaggtgcaaaggggatgagactgcgttcagtgtcctggagggagttcatagctatactgtcagcctcagctttgaccatgctgtggtcgatgagcagtgccaactgaactgtggggggcatgagagtcaagtgactctaaaaggcaacctcatcttcctggatgtcccaaaattcgtagatggcagctacatgcagacatatcatagttctgtacccacaggagcaaatatcccaagcccaacagactggctgaatgccctgtttggcaatgggctgagtaggtggattctgggggtgataggggttctactggggggattggctctctttttcttaatcatatctttgttcaaactgggaacaaaacaggtatttcgatcaaggacgaagctggcttag

SEQ ID NO: 4813 - RNA, 3222 nt, synthetic construct
  misc_feature 1..3222: note = derived and/or modified CDS sequence (wt) from SFTSV(SPL128A)__AB985325.1__GP
  source 1..3222: mol_type = other RNA
atgatgaaagtcatctggttctcctctctgatctgcttagtcatccaatgcagtggggatacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtcttttttgaacggccaacatttgatggatacgttggctggggctgtggcagtgggaagtcaaggactgagtcaggagagctctgcagctcagactcagggaccagttccggtcttctgccctcagatagggttctctggataggtgatgttgcttgccagcctatgacacccatccctgaagagacatttctggagctgaagagctttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagtggatcatgtaggggggacatgcagttttgcaaggtggcaggttgtgaacatggggaagaggcatctgaagccaaatgcagatgctcactagtgcacaagcccggggaagttgttgtgtcatatggagggatgcgtgtcagaccaaagtgctatggtttctccagaatgatggcaacactagaggtgaactcaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcagttgcatgttcccagatggttgtgacgcagtggactgcacattctgtcgtgagtttctaaaaaatcctcagtgctaccctgcaaagaaatggttgttcatcattattgtcatcctccttggatatgcaggcctcatgctactcaccaatgtccttaaggcaatcggggtttgggggtcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagatgatgttaggatcgagatggcaaggcctagaagggtaaggcactggatgtactcccctgtcatcctgactattctagcaattgggcttgctgagggctgcgatgagatggtccatgcagattctaaacttgtttcgtgcaagcaagggagcggaaatatgaaggaatgtgtcacaactgggagggcgctccttcctgcggtgaacccaggacaagaggcatgtctgcacttcacagcaccagggagtccggactcaaaatgtctcaaaatcagagttaagaggatcaacctgaaatgcaagaagtcatcatcatatttcgttcctgatgctcggtccaggtgtacatctgtgaggagatgccgctgggcaggagactgtcagtctgggtgcccctctcatttcacgtccaactccttttctgatgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgccgcatgggtcccatcagcagtcatagagcttacaatgccctcaggggaagtgaggacattccaccccatgagcggcatccctactcaagtcttcaagggtgtgagtgtgacttacttgggctcagatatggaggtatctggcttgactgacctgtgtgaaatagaagagctcaagtccaagaagctggcattagctccctgcaatcaggctggcatgggggttgtaggcaaggttggagagatacaatgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattgggggactgaggtttgagagaagccatgacagccagggcaaaatatctggtagccccttggacatcacagccataagagggtctttttcagttaattatagaggccttcgactgagcctctcagaaattactgctacttgcacaggggaggtgacaaatgtgagtgggtgttactcttgcatgacaggcgccagggtctccatcaaactgcatagcagcaaaaatagcactgcacatgtaaggtgcaaaggggatgagactgcgttcagtgtcctggagggagttcatagctatactgtcagcctcagctttgaccatgctgtggtcgatgagcagtgccaactgaactgtggggggcatgagagtcaagtgactctaaaaggcaacctcatcttcctggatgtcccaaaattcgtagatggcagctacatgcagacatatcatagttctgtacccacaggagcaaatatcccaagcccaacagactggctgaatgccctgtttggcaatgggctgagtaggtggattctgggggcgataggggttctactggggggattggctctctttttcttaatcatatctttgttcaaactgggaacaaaacaggtatttcgatcaaggacgaagctggcttag

SEQ ID NO: 4814 - RNA, 3222 nt, synthetic construct
  misc_feature 1..3222: note = derived and/or modified CDS sequence (wt) from SFTSV(SPL129A)__AB985326.1__GP
  source 1..3222: mol_type = other RNA
atgatgaaagtcatctggttctcctctctgatctgcttggtcattcaatgcagtggggacacgggcccaatcatatgtgcagggcccatccactcaaacaagagtgccaacataccccacctgcttggttactctgagaagatttgtcagatagatcgactgatacatgtttcgtcatggctgagaaaccattcacagtttcagggctacgtggggcagcgaggtggacgctctcaggtgagctactacccagctgaaaactcttactcaaggtggagcggacttctaagcccctgtgatgctgattggcttgggatgcttgtcgtgaagaaggccaaggggtctgatatgatagttcctggaccatcatacaaggggaaagtcttttttgagcggccaacttttgatggatacgtgggctggggctgtggtagtgggaagtcaaggacagagtcaggtgaactctgcagctcagactcagggaccagttctggtcttctgccctcagatagagttctctggataggtgatgttgcttgccagcctatgacacccatccctgaggagacatttctggagctgaagagttttagccagagtgaattcccagacatatgcaagattgatggcattgtgttcaatcagtgtgagagtgagagtttacctcagccctttgatgtcgcatggatggatgtaggtcactctcataaaatcatcatgagggagcacaagaccaaatgggtacaagagagctcatctaaggattttgtgtgctacaaggaaggaactgggccgtgttctgaatcagaagaaaagacttgcaagaccagtggatcatgcaggggggacatgcagttttgcaaggtggcaggttgtgaacatggggaagaggcatctgaagccaagtgtagatgttctctagtgcacaagcccggggaagttgttgtgtcatatggagggatgcgtgtcagaccaaagtgttatggtttctccagaatgatggcaacactagaggtgaacccaccagagcaaaggattggccaatgcactggctgccatctagaatgcataagtgggggtgtgaggctaatcactctaactagtgagctcaagtcagccactgtctgtgcttcccacttttgtagttctgccacaagtggcaagaaaagcacggagattcaattccactcagggtcattagttgggaaagcagcaatacacgtcaaaggggctttggtggatggaactgaattcacatttgagggtagttgcatgttcccagatggttgtgacgcagtggattgcacattctgtcgtgagtttctaaagaatcctcagtgctaccctgcaaagaaatggttgttcattattattgtcatcctccttggatatgcaggcctcatgctactcaccaatgtccttaaggcaatcggggtttggggatcatgggtcatagctccagtgaagctaatgtttgccatcatgaagaaactgatgagatctgtgagctgcttgatggggaaattgatggataggggaaggcaagtgatccatgaagaaataggggagaatagagagggcaaccgagatgatgttaggatcgagatggcaagaccgagaagggtgaggcattggatgtactcacctgtcatcctgactattctagcaattgggctagctgagggctgcgatgagatggtccatgctgattctaaacttgtttcgtgcaggcaagggagtgggaacatgaaagaatgtgtcacaactgggagggcgctccttcctgcggtgaacccaggacaagaggcatgtctgcacttcacggcacctgggagcccggactcaaaatgtctcaagatcaaggttaagaggatcaacctaaaatgtaagaagtcatcatcatattttgttcctgatgctagatccaggtgtacatctgtgaggagatgtcgctgggcaggagactgtcagtctgggtgcccctctcatttcacgtccaactccttctctgatgattgggcaggtaaaatggacagggctggtctaggattcagtgggtgctctgatggatgtgggggagcagcctgcggctgctttaatgcggccccttcatgcatcttttggaggaaatgggtagagaatccacatgggatcatctggaaagtatctccatgtgctgcatgggtcccatcagcagtcatagagctaacgatgccctcgggggaagtgaggacattccaccccatgagtggcatccccacacaagtcttcaagggtgtgagtgtgacttacttaggctcagatatggaggtgtctggcttgactgacctgtgtgagatagaagagctaaagtccaagaagctggcattagctccctgcaatcaggctggcatgggggtagtaggcaaggttggagagatacagtgcagcagcgaggaaagcgcccgtactataaagaaagatgggtgcatatggaatgctgaccttgtaggcatagagctacgggtggatgacgctgtgtgctactctaagatcactagtgtggagacagttgcaaactactctgccatacccaccactattggggggctgaggtttgagagaagccatgacagccagggtaaaatatctggtagccccctagacatcacagccataagagggtctttttcagttaattatagaggccttcgactgagcctctcagaaattactgccacttgcactggggaggtgacgaatgtgagtgggtgttactcttgcatgacaggcgccaaagtctccatcaaactgcatagcagcaaaaatagcactgcccatgtaagatgcaaagaggatgagaccgcgtttagtgtcctggagggagttcatagctatactgtcagtctcagctttgaccatgcagtggtcgatgagcagtgccagctgaactgtggggggcatgagagtcatgtgactctaaaaggcaaccttatcttcctggatgtcccaaaatttgtagatggcagctatatgcagacatatcatagttctgtgcccacaggggctaatatcccaagcccgacagactggctgaatgccttgtttggcaatgggctgagtagatggattctgggggtgatgggggttctgctgggggggttggctctcttcttcttaatcatgtctttgttcaaactgggaacaaaacaggtatttcgatcaaggacgaagctggcttag

SEQ ID NO: 4815 - RNA, 3222 nt, synthetic construct
  misc_feature 1..3222: note = derived and/or modified CDS sequence (wt) from SFTSV(YG1)__AB817987.1__GP
  source 1..3222: mol_type = other RNA
atgatgaaagtcatctggttctcctctctgatctgcttagtcattcaatgcagtggggacacgggcccaatcatatgcgcagggcccatccactcaaacaagagtgccaacataccccacctgcttggttactctgagaagatttgtcagatagatcggctgatacatgtttcgtcatggctgagaaaccattcacaatttcagggctacgtggggcagcgaggtggacgctctcaggtgagttacttcccagctgaaaactcttactcaaggtggagtggacttctaagcccctgtgatgctgattggcttgggatgcttgtcgtgaagaaggccaaggggtctgatatgatagttcctgggccttcatacaagggaaaagtcttttttgaacggccaacctttgatggatacgttggctggggctgtggcagtgggaagtcaaggactgagtcaggagagctctgcagctcagactcagggaccagttccggtcttctgccctcagatagagttctctggataggtgatgttgcttgccagcctatgacacccatccctgaagagacatttctggagctgaagagttttagccagagtgaatttccagacatatgcaaaattgatggcattgtgttcaaccagtgtgagagtgagagcctacctcagccctttgatgttgcttggatggatgttggccactctcataaaatcatcatgagggagcacaagaccaaatgggtacaagagagctcatctaaggattttgtgtgctacaaggaagggactgggccgtgttctgaatcagaagaaaagacttgcaagaccagcggatcatgtaggggggacatgcagttttgcaaggtggcaggttgtgaacatggggaagagacatctgaagccaaatgcagatgctcactagtgcacaagcccggggaagttgttgtgtcatatggagggatgcgtgtcagaccaaaatgctatggtttctccagaatgatggcaacactagaggtgaacccaccagagcaaaggattggccaatgcactggctgccatctagaatgcataaatgggggtgtgaggctaatcactctaactagtgagctcaagtcagctactgtctgtgcttcccacttttgtagttctgccacaagtggcaagaaaagcacggagattcaattccactcagggtcattagttgggaaaacagcaatacacgtcaaaggggcattggtggatggaactgaattcacatttgagggcagttgcatgttcccagatggttgtgacgcagtggactgcacattctgtcgtgagtttctgaaaaatcctcagtgctaccctgcaaagaaatggttgttcatcattattgtcatcctccttggatatgcaggcctcatgctactcaccaatgtccttaaggcaatcgggatttgggggtcatgggtcatagctccagtgaagctaatgtttgccatcataaagaaactgatgagatctgtgagctgcttgatggggaaattgatggataggggaaggcaagtgatccatgaagaaataggggagaatagagagggcaaccaagaagatgttaggatcgagatggcaaggcctagaagggtaaggcactggatgtactcacctgtcatcctggctattctagcaattgggcttgctgagggctgcgatgagatggtccatgcagattctaaacttgtttcatgcaagcaagggagcggaaatatgaaggaatgtgtcacaactgggagggcgctccttcctgcggtgaacccaggacaagaggcatgtctgcacttcacagcaccagggagtccggactcaaaatgtctcaaaatcaaagttaagaggatcaacctgaaatgcaagaagtcatcatcatatttcgttccagatgctcggtccaggtgtacatctgtgaggagatgccgctgggcaggagactgtcagtctgggtgcccctctcatttcacgtccaactccttttctgacgattgggcaggtaaaatggacagggctggtctaggattcagtgggtgctctgatggatgtggaggagcagcctgcggctgctttaatgcggccccttcatgcatcttctggaggaaatgggtagagaatccacatgggatcatctggaaagtatctccatgtgctgcatgggtcccatcagcagtcatagagcttacaatgccctcgggggaagtgaggacattccaccccatgagcggcatccctactcaagtcttcaagggtgtgagtgtgacttacttaggctcagatatggaggtatctggcttgactgatctgtgtgaaatagaagagctcaagtccaagaagctggcattagctccctgcaatcaggctggcatgggggttgtaggcaaggttggagagatacaatgcagtagtgaggaaagtgcccgtaccataaaaaaagatgggtgtatatggaatgctgacctcgtgggcatcgagctacgagtggatgacgctgtgtgctactctaagatcactagtgtggaggcagttgcaaactactctgccatacccaccactattggggggctgaggtttgagagaagccatgacagccaaggcaaaatatctggtagccccttggacatcacagccataagagggtctttttcagttaactatagaggccttcggctgagcctctcagaaattactgctacttgcacaggggaggtgacaaatgtgagtgggtgttactcttgcatgacaggcgccaaagtctccatcaaactgcatagcagcaaaaatagcactgcacatgtaaggtgcaaaggggatgagactgcgttcagtgtcctggagggagttcatagctatactgtcagcctcagttttgaccatgcagtggtcgatgagcagtgccagctgaactgtggggggcatgagagtcaagtgactctaaaaggcaacctcatcttcctggatgtcccaaaattcgtagatggcagctacatgcagacatatcatagttctgtacccacaggagcaaatatcccaagcccaacagactggctgaatgccctgtttggcaatgggctgagtaggtggattctgggggtgataggggttctactggggggattggctctctttttcttaatcatgtctttgttcaaactgggaacaaaacaggtatttcgatcaaggacgaagctggcttag

SEQ ID NO: 4816 - RNA, 3222 nt, synthetic construct
  misc_feature 1..3222: note = derived and/or modified CDS sequence (wt) from SFTSV(SDTA_1)__KX641913.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttgggtactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggccagggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcttatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcgggttgcgaacatggagaggagacatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactgatgagaactgtgagctgcttggtggggaaattgatggataggggaaggcaagtgatccatgaggaaataggggagaatggggagggcaaccaagatgatgttaggattgagattgcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggcgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgatgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagcgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagcactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4817 - RNA, 3222 nt, synthetic construct
  misc_feature 1..3222: note = derived and/or modified CDS sequence (wt) from SFTSV(SDTA_2)__KX641914.1__GP
  source 1..3222: mol_type = other RNA
atgatgaaagtcatctggttctcctctctgatctgcttagtcattcaatgcagtggggattcgggcccaatcatctgcgcaggacctatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgcaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcatatgattggtcaatgcactggctgccatctagaatgcataaatgggggtgtgaggctaatcactctaaccagtgagctcaggtcagctactgtctgtgcttcccacttttgcagttctgcctcaagtggcaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggtagtaggcaaggttggagagatacagtgcagtagcgaggagagtgcccgtaccataaaaaaagatgggtgcatatggaacgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggttccttttctgttaactatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaacatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4818 - RNA, 3222 nt, synthetic construct
  misc_feature 1..3222: note = derived and/or modified CDS sequence (wt) from SFTSV(SDTA_3)__KX641915.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtgggtcatgcagaggggacatgcagttttgcaaggtggcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctattcatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgaggtggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggttccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4819 - RNA, 3222 nt, synthetic construct
  misc_feature 1..3222: note = derived and/or modified CDS sequence (wt) from SFTSV(SDTA_4)__KX641916.1__GP
  source 1..3222: mol_type = other RNA
atgatgaaagtcatctggttctcctctctgatctgcttagtcattcaatgcagtggggattcgggcccaatcatctgcgcaggacccatccactcaaataagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagcggatcatgcagaggggacatgcagttttgcaaggtggcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgccacaagtggtaagaaaagcacggagattcatttccactcaggatcattggttgggaaaacagctatccatgtcaaaggggcattggtagatggaactgaattcacatttgagggtagttgcatattcccagatggatgtgatgcagtggactgcacattctgtcgtgagtttctaaaaaatcctcagtgctaccctgcaaagaagtggctgttcatcattattgtcatcctccttggatatgcaggactcatgttactcaccaatgtccttaaggcaattggggtctggggatcatgggtaatagctccagtaaagctaatatttgccatcatgaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggggggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgctcggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaatgcagacctcgtgggtatagagctacgagtggatgacgctgtgtgctactctaagattactagtgtggaggcagttgcaaactactctgccatacccaccactattggggggctgaggtttgagagaagccatgacagccagggcaagatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgttcggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4820 - RNA, 3222 nt, synthetic construct
  misc_feature 1..3222: note = derived and/or modified CDS sequence (wt) from SFTSV(HBGS13_human_2015)__KY440773.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggccttctgccctcaaatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcacaaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtttcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggattgctgagagctgtgatgagatggtccatgctgattctaagcttgtttcatgcaggcaagggagcggaaacatgaaggaatgtgtcacaactgggagggcgcttcttcctgcggtgaacccaggtcaagaggcatgtctgcacttcacggcacctgggagtccggactcaaaatgtctcagaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactaaactgtgggggacatgagagtcaagtgactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtggatcctgggggtgatgggggttctgcttgggggattggctctctttatcattatcatgtctttgttcaagctgggaacaaaacaggtatttcgatcaaggacaaagctggcttag

SEQ ID NO: 4821 - RNA, 3222 nt, synthetic construct
  misc_feature 1..3222: note = derived and/or modified CDS sequence (wt) from SFTSV(HBMC16_human_2015)__KY440776.1__GP
  source 1..3222: mol_type = other RNA
atgatgaaagtcatctggttctcctctctggtctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctatgtagggcagcgaggtggacgctctcaggtgagctactacccagctgagaattcttactcgaggtggagtggacttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggcagtgggaagtctaggacagagtcaggagagctctgcagttcagactcagggactagttctggtctactgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataaaatcatcatgagggagcacaagaccaaatgggtacaggagagctcatctaaggattttgtgtgctacaaggaagggactggaccttgttctgaatcagaagaaaaggcttgcaagaccagtggatcatgcaggggggacatgcagttttgcaaggtggcaggttgtgaacatggggaggaggcatctgaagccaagtgtagatgctcacttgtgcacaagcctggggaagtcgttgtgtcatatggagggatgcgtgtcagaccaaagtgctatggtttctccagaatgatggcaacaatggaggtgaacccaccagagcaaaggattggtcaatgcactggctgccatctagaatgcataaatgggggtgtgaggctaatcactctaactagtgagctcaagtcagctactgtctgtgcttcccacttttgcagttctgccacaagtggtaagaaaagcacggagattcatttccactcaggatcattggttgggaaagcagctatccatgtcaaaggggcattggtagatgggactgaattcacatttgagggtagttgcatgttcccagatggatgtaatgcagtggactgcacattctgtcgtgagtttctaaaaaatcctcagtgctaccctgcaaagaagtggctgttcatcattattgtcatcctccttggatatgcaggcctcatgctactcaccaatgtccttaaggcaattggggtctgggggtcatgggtgatagctccagtgaagctaatgtttgccatcatgaagaaactaatgagaactgtgagctgcttggtggggaaattgatggatagaggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcaggcaagggagcggaaatatgaaggaatgcgtcacaactgggagagcgcttcttcctgcggtgaacccaggacaagaggcgtgtctgcacttcacggcacctgggagtccggactcaaaatgtctcaaaattaaggtcaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggcaagatggacagggctggtcttggattcagtggctgctctgatggatgtggaggagcagcctgcggatgctttaatgcggccccttcatgcatcttctggaggaaatgggtggagaatccacatgggatcatctggaaagtatctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaagaagctggcattagctccctgcaaccaggctggcatgggggttgtaggcaaggttggagagatacagtgcagtagcgaggagagtgcccgtaccataaaaaaagatgggtgtatatggaatgcagacctcgtgggaatagagctacgagtggatgacgctgtgtgctactctaagattactagtgtggaggcagttgcaaactactctgccatacctaccactattggggggctgaggtttgagagaagccatgacagccagggtaaaatatctggtagccccctggacatcacagctataagaggatccttttctgtaaattatagaggccttcgattgagtctctcagaaattactgccacttgcacaggggaggtgacaaatgtgagtgggtgttattcttgcatgacaggcgccaaagtctccatcaaattgcatagcagcaaaaatagcactgcccatgttagatgtaaaggggatgagactgcattcagtgtcttggagggagtccatagctacactgtcagcctcagctttgaccatgcagtagtcgatgagcagtgccaactgaactgtgggggacatgagagtcaagtgactctaaagggcaacctcatcttcctggatgtcccaaaatttgtggatggcagctacatgcagacatatcacagcactgtgcccacaggggcaaatatcccaagccctacagattggctgaatgccttgtttggcaatgggctgagtaggtggatcctgggggtgataggggttctactggggggattggctctctttttcttgatcatgtttttgttcaagctgggaacaaaacaggtgtttcgatcgaggacgaagctggcttag

SEQ ID NO: 4822 - RNA, 3222 nt, synthetic construct
  misc_feature 1..3222: note = derived and/or modified CDS sequence (wt) from SFTSV(HBMC5_human_2016)__KY440770.1__GP
  source 1..3222: mol_type = other RNA
atgatgaaagtcatctggttctcctctctggtctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctatgtagggcagcgaggtggacgctctcaggtgagctactacccagctgagaattcttactcgaggtggagtggacttctaagcccctgtgatgctgattggcttgggatgcttgtcgtgaagaaggccaaggggtctgatatgatagttcctgggccttcatacaaggggaaagtcctttttgaacggccaacttttgatggatacgtaggctggggctgtggcagtgggaagtctaggacagagtcaggagagctctgcagttcagactcagggactagttctggtctactgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataaaatcatcatgagggagcacaagaccaaatgggtacaggagagctcatctaaggattttgtgtgctacaaggaagggactggaccttgttctgaatcagaagaaaaggcttgcaagaccagtggatcatgcaggggggacatgcagttttgcaaggtggcaggttgtgaacatggggaggaggcatctgaagccaagtgtagatgctcacttgtgcacaagcctggggaagtcgttgtgtcatatggagggatgcgtgtcagaccaaagtgctatggtttctccagaatgatggcaacaatggaggtgaacccaccagagcaaaggattggtcaatgcactggctgccatctagaatgcataaatgggggtgtgaggctaatcactctaactagtgagctcaagtcagctactgtctgtgcttcccacttttgcagttctgccacaagtggtaagaaaagcacggagattcatttccactcaggatcattggttgggaaagcagctatccatgtcaaaggggcattggtagatgggactgaattcacatttgagggtagttgcatgttcccagatggatgtaatgcagtggactgcacattctgtcgtgagtttctaaaaaatcctcagtgctaccctgcaaagaagtggctgttcatcattattgtcatcctccttggatatgcaggcctcatgctactcaccaatgtccttaaggcaattggggtctgggggtcatgggtgatagctccagtgaagctaatgtttgccatcatgaagaaactaatgagaactgtgagctgcttggtggggaaattgatggatagaggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcaggcaagggagcggaaatatgaaggaatgcgtcacaactgggagagcgcttcttcctgcggtgaacccaggacaagaggcgtgtctgcacttcacggcacctgggagtccggactcaaaatgtctcaaaattaaggtcaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggcaagatggacagggctggtcttggattcagtggctgctctgatggatgtggaggagcagcctgcggatgctttaatgcggccccttcatgcatcttctggaggaaatgggtggagaatccacatgggatcatctggaaagtatctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaagaagctggcattagctccctgcaaccaggctggcatgggggttgtaggcaaggttggagagatacagtgcagtagcgaggagagtgcccgtaccataaaaaaagatgggtgtatatggaatgcagacctcgtgggaatagagctacgagtggatgacgctgtgtgctactctaagattactagtgtggaggcagttgcaaactactctgccatacctaccactattggggggctgaggtttgagagaagccatgacagccagggtaaaatatctggtagccccctggacatcacagctataagaggatccttttctgtaaattatagaggccttcgattgagtctctcagaaattactgccacttgcacaggggaggtgacaaatgtgagtgggtgttattcttgcatgacaggcgccaaagtctccatcaaattgcatagcagcaaaaatagcactgcccatgttagatgtaaaggggatgagactgcattcagtgtcttggagggagtccatagctacactgtcagcctcagctttgaccatgcagtagtcgatgagcagtgccaactgaactgtgggggacatgagagtcaagtgactctaaagggcaacctcatcttcctggatgtcccaaaatttgtggatggcagctacatgcagacatatcacagcactgtgcccacaggggcaaatatcccaagccctacagattggctgaatgccttgtttggcaatgggctgagtaggtggatcctaggggtgataggggttctactggggggattggctctctttttcttgatcatgtttttgttcaagctgggaacaaaacaggtgtttcgatcgaggacgaagctggcttag

SEQ ID NO: 4823 - RNA, 3222 nt, synthetic construct
  misc_feature 1..3222: note = derived and/or modified CDS sequence (wt) from SFTSV(HB29)__KP202164.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatccaccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaataacactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4824 - RNA, 3222 nt, synthetic construct
  misc_feature 1..3222: note = derived and/or modified CDS sequence (wt) from SFTSV(HNXY_115)__KC292312.1__GP
  source 1..3222: mol_type = other RNA
atgatgaaagtcatctggttctcctctctgatctactttgtcattcaatgcagtggggactcaggctcaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgttctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactctgggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgagcatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacagagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcttgggggtgataggggttctacttggggggttggctctctttttcatgattatgtctttgttcaagctgggaacaaaacaggtatttcgatcaaggacgaagctggcttag

SEQ ID NO: 4825 - RNA, 3222 nt, synthetic construct
  misc_feature 1..3222: note = derived and/or modified CDS sequence (wt) from SFTSV(HNXY_144)__KC292307.1__GP
  source 1..3222: mol_type = other RNA
atgatgaaagtcatctggttctcctctctgatctgctttgtcattcaatgcagtggggactcgggcccaatcatctgcgcaggacctatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttctttgagcgaccaacttttgatggatatgtgggctggggctgtggcagtgggaagtctaggacagagtcaggagagctctgcagttcagactcagggactagctctggtcttctgccctcagatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggttgctcagatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagcccactggacatcacagctataagaggatctttttctgttaattatagaggccttcgactgagcctctcagaaattactgctacctgcacaggggaggtgacaaatgtgagtggatgttattcttgcatgacaggcgcaaaagtctctatcaaattgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtggatcctgggggtgatgggggttctgcttggggggttggctctctttttcatgatcatgtctttgttcaagctgggaacaaaacaggtatttcgatcaaggacaaagctggcttag

SEQ ID NO: 4826 - RNA, 3222 nt, synthetic construct
  misc_feature 1..3222: note = derived and/or modified CDS sequence (wt) from SFTSV(HNXY_157)__KC292305.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcaaatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcacaaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtcttagaattaaggttaagaggatcaacctaaaatgtaagaagtcatcatcatattttgttcctgatgcccggtctagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtaactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtgggtcctgggggtgatgggggttctgcttgggggattggctctctttttcatgatcatgtctttgttcaagctgggaacaaaacaggtatttcgatcaaggacaaagctggcttag

SEQ ID NO: 4827 - RNA, 3222 nt, synthetic construct
  misc_feature 1..3222: note = derived and/or modified CDS sequence (wt) from SFTSV(HNXY_170)__KC292304.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcaaatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcacaaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtcttagaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaaataactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtgggtcctgggggtgataggggttctgcttgggggattggctctctttttcatgatcatgtctttgttcaagctgggaacaaaacaggtatttcgatcaaggacaaagctggcttag

SEQ ID NO: 4828 - RNA, 3222 nt, synthetic construct
  misc_feature 1..3222: note = derived and/or modified CDS sequence (wt) from SFTSV(HNXY_174)__KC292306.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaggagacatttctggagctgaagagttttagccaaagtgaattcccagacatatgcagaattgatggcattgtgttcaaccagtgtgagggtgagagtctacctcagccctttgatgttgcatggatggatgttggccactctcacaaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagcggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcagaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagttaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacgtatcatagcactgtgcccacaggggcaaacatcccaagcccaacagactggctgaatgccttgtttggcaatgggatgagtaggtggatcctgggggtgatgggggttctgcttgggggattggctctctttttcatgatcatgtctttgttcaagctgggaacaaaacaggtatttcgatcaaggacaaagctggcttag

SEQ ID NO: 4829 - RNA, 3222 nt, synthetic construct
  misc_feature 1..3222: note = derived and/or modified CDS sequence (wt) from SFTSV(HNXY_182)__KC292324.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgcagggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaaggaactgggccttgttctgaatcagaagaaaagacttgtaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacggagattcaattccactcaggatctttggttgggaaaacagcaatacacgtcaaaggggcattggtagatggaactgaattcacatttgagggtagttgcatgttcccagatggttgtgatgcagtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgtcaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaaaaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtggagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgactgacctatgtgagatagaggagctcaagtccaagaagctggcattagctccctgcaaccaggctggcatgggggttgtaggcaaggttggagagattcagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaagtgacaaatgtaagtggatgttattcttgcatgacaggcgccaaagtctctattaaactgcacagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctggggttgataggggttctgcttggggggttggctctctttttcatgattatgtctttgttcaagctgggaacaaaacaggtatttcgatcaaggacgaagctggcttag

SEQ ID NO: 4830 - RNA, 3222 nt, synthetic construct
  misc_feature 1..3222: note = derived and/or modified CDS sequence (wt) from SFTSV(HNXY_188)__KC292301.1__GP
  source 1..3222: mol_type = other RNA
atgatgaaagtcatctggttctcctctctgatctgcttagtcattcaatgcggtgggggtacgggcccaatcatctgcgcaggacccatccactcaaacaagagtgctgacataccccacctgcttggctactctgagaagatttgtcagatagatcggctgatacatgtttcgtcttggcttagaaaccactcacaatttcagggctacgtagggcagcgaggcggacgctctcaggtgagctactacccagccgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactccgggactagttctggtcttctgccctcggatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctaatcactctaaccagtgagctcaagtcagctactgtctgcgcttcccacttttgcagttctgccacaagtggtaagaaaagcacggagattcaattccactcaggatcattggttgggaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaagggagcggaaatatgaaggaatgtgtcacaactgggagggcgcttcttcctgcggtgaacccagggcaagaggcgtgtctgcacttcacggcacctggaagtccggactcaaaatgtctcaaaattaaagttaagaggatcaacctaaaatgtaaaaagtcatcatcatattttgttcctgatgcccggtccagatgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctagtgggtatagagctacgggtggatgacgctgtgtgctactctaagatcactagtgtggaggcagttgcaaactactccgccatacccaccactattggggggctgaggtttgagagaagccatgacagccagggtaaaatatctggtagccccctggacatcacagctataagaggatctttttctgtcaattatagaggccttcgactgagtctctcagaaatcactgctacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtctttgtttaagctgggaacaaaacagatatttcgatcgaggacaaagctggcttag

SEQ ID NO: 4831 - RNA, 3222 nt, synthetic construct
  misc_feature 1..3222: note = derived and/or modified CDS sequence (wt) from SFTSV(HNXY_191)__KC292323.1__GP
  source 1..3222: mol_type = other RNA
atgatgaaagtcatctggttctcctctctgatctgcttagtcattcaatgcggtggggatacgggcccaatcatctgcgcaggacccacccactcaaacaagagtgctgacataccccacctgcttggctactctgagaagatttgtcagatagatcggctgatacatgtttcgtcttggcttagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactccgggactagttctggtcttctgccctcggatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctggaatgcataaatgggggtgtgaggctaatcactctaaccagtgagctcaagtcagctactgtctgcgcttctcacttttgcagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaagggagcggaaatatgaaggaatgtgtcacaactgggagggcgcttcttcctgcggtgaacccagggcaagaggcgtgtctgcacttcacggcacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggtatagagctacgggtggatgacgctgtgtgctactctaagatcactagtgtggaggcagttgcaaactactccgccatacccaccactattggggggctgaggtttgagagaagccatgacagccagggtaaaatatctggtagccccctggacatcacagctataagaggatctttttctgtcaattatagaggccttcgactgagtctctcagaaatcactgccacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtctttgtttaagctgggaacaaaacagatatttcgatcaaggacaaagctggcttag

SEQ ID NO: 4832 - RNA, 3222 nt, synthetic construct
  misc_feature 1..3222: note = derived and/or modified CDS sequence (wt) from SFTSV(HNXY_195)__KC292326.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgcagggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgcctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggttcatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4833 - RNA, 3222 nt, synthetic construct
  misc_feature 1..3222: note = derived and/or modified CDS sequence (wt) from SFTSV(HNXY_2)__KC292318.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttattctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctcaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccatcccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagcgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccatagctacactgtcagcctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggatgagtaggtggatcctgggggtgataggggttctacttggggggttggctctctttttcatgattatgtctttgttcaagctgggaacaaaacaggtatttcgatcaaggacgaagctggcttag

SEQ ID NO: 4834 - RNA, 3222 nt, synthetic construct
  misc_feature 1..3222: note = derived and/or modified CDS sequence (wt) from SFTSV(HNXY_202)__KC292325.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcaaatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcacaaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcagaattaaggttaagaagatcaacctaaaatgtaagaggtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtaactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtggatcctgggggtgatgggggttctgcttgggggattggctctctttttcatgatcatgtctttgttcaagctgggaacaaaacaggtatttcgatcaaggacaaagctggcttag

SEQ ID NO: 4835 - RNA, 3222 nt, synthetic construct
  misc_feature 1..3222: note = derived and/or modified CDS sequence (wt) from SFTSV(HNXY_206)__KC292302.1__GP
  source 1..3222: mol_type = other RNA
atgatgaaagtcatctggttctcctctctgatctgcttagtcattcaatgcggtggggatacgggcccaatcatctgcgcaggacccatccactcaaacaagagtgctgacataccccacctgcttggctactctgagaagatttgtcagatagatcggctgatacatgtttcgtcttggcttagaaaccactcacaatttcagggctacgtagggcagcgaggcggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactcggggactagttctggtcttctgccctcggatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctaatcactctaaccagtgagctcaagtcagctactgtctgcgcttctcacttttgcagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctacaaagaagtggctgttcatcattattgtcatcctccttggatatgcaggcctcatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggaaaatagagagggcaaccaagatgatattaggattgagatggccagacccaggagggtaaggcattggatgtactcgcctgtcatcctgactattctagcaatagggcttgctgagggctgtgatgagatggtccatgctgattctaaacttgtttcgtgcaggcaagggagcggaaatatgaaggaatgtgttacaactgggagggcgcttcttcctgcggtgaacccagggcaagaggcgtgtctgcacttcacgacacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatccccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctagtgggtatagagctacgggtggatgacgctgtgtgctactctaagatcactagtgtggaggcagttgcaaactactccgccatacccaccactattggggggctgaggtttgagagaagccatgacagccagggtaaaatatctggtagccccctggacatcacagctataagaggatctttttctgtcaattatagaggccttcgactgagtctctcagaaatcactgccacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatccctagccctacagattggctaaatgccttgtttggcaatgggctgagtaggtggattctgggggtgataggggtcctactggggggattggctctctttttcttgatcatgtctttgtttaagctgggaacaaaacagatatttcgatcgaggacaaagctggcttag

SEQ ID NO: 4836 - RNA, 3222 nt, synthetic construct
  misc_feature 1..3222: note = derived and/or modified CDS sequence (wt) from SFTSV(HNXY_207)__KC292315.1__GP
  source 1..3222: mol_type = other RNA
atgatgaaagtcatctggttcccctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgagactaataactctaaccagtgagctcaagtcagctactgtctgtgcttctcacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatgtttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggttcatagctacactgtcagtctcagttttgaccatgcagtggtcgatgagcagtgccagctgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4837 - RNA, 3222 nt, synthetic construct
  misc_feature 1..3222: note = derived and/or modified CDS sequence (wt) from SFTSV(HNXY_224)__KC292317.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacctgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattgttgtcatcctccttgggtatgcaggcctcatgctactcaccaatgtcctcaaggcaattgggatttggggatcatgggtcatagctccagtgaagctaatgtttgccatcataaagaaactaatgagaactgtgagctgcttgatggggaaattgatggataggggaaggcaagtgatccatgaggagataggggagaatagagagggcaaccaagatgatgtcaggattgagatggcaagacccagaagggtaaggcattggatgtactcacctgtcatcctgactattttagcaatagggcttactgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgcgagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaacccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggtaggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaagatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggttcatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggagttctacttggggggttggctctctttttcatgattatgtctttgttcaagctgggaacaaaacaggtatttcgatcaaggacgaagctggcttag

SEQ ID NO: 4838 - RNA, 3222 nt, synthetic construct
  misc_feature 1..3222: note = derived and/or modified CDS sequence (wt) from SFTSV(HNXY_231)__KC292313.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctggcatacctcacctgctgggttactctgagaagatatgtcagatagatcggctgatacatgtttcgtcatggctcaggaaccactcacaatttcagggctacgtaggccagcgaggtggacgctctcaggtgagctactacccagctgagaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgactgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggtatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccacagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4839 - RNA, 3222 nt, synthetic construct
  misc_feature 1..3222: note = derived and/or modified CDS sequence (wt) from SFTSV(HNXY_245)__KC292320.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagcgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcaaatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcacaaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcagaattaaggttaagaggatcaacctaaagtgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactatcagtctcagttttgaccatgcagtagtcgatgagcagtgccaactgaactgtgggggacatgagagtcaagtaactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtggatcctgggggtgatgggggttctgcttgggggattggctctctttttcatgatcatgtctttgttcaagctgggaacaaaacaggtatttcgatcaaggacaaagctggcttag

SEQ ID NO: 4840 - RNA, 3222 nt, synthetic construct
  misc_feature 1..3222: note = derived and/or modified CDS sequence (wt) from SFTSV(HNXY_262)__KC292309.1__GP
  source 1..3222: mol_type = other RNA
atgatgaaagtcatctggttctcctctctgatctgctttgtcattcaatgcagcggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcgggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggctgtggcagtgggaagtccaggacagagtcaggagagctctgcagttcagactcagggactagctctggtcttctgccctcagatagggttctctggataggtgatgttgcttgtcagcccatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcacaaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtgaggcattggatgtactcacctgtcatcctgactattttggcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagttaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaggtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagtactgcccatgtaagatgcaaaggggatgagactgcattcagtgtcttggagggagtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtggatcctgggggtgatgggggttctgcttgggggattggctctctttttcatgatcatgtctttgttcaagctgggaacaaaacaggtatttcggtcaaggacaaagctggcttag

SEQ ID NO: 4841 - RNA, 3222 nt, synthetic construct
  misc_feature 1..3222: note = derived and/or modified CDS sequence (wt) from SFTSV(HNXY_278)__KC292322.1__GP
  source 1..3222: mol_type = other RNA
atgatgaaagtcatctggttctcctctctgatctgcttagtcattcaatgcggtggggatacgggcccaatcatctgcgcaggacccacccactcaaacaagagtgctgacataccccacctgcttggctactctgagaagatttgtcagatagatcggctgatacatgtttcgtcttggcttagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactccgggactagttctggtcttctgccctcggatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctaccccagccctttgatgttgcatggatggatgttggccactctcataaaatcatcatgagggagcataagaccaaatgggtacaagagagctcatccaaggattttgtgtgctataaggaagggactgggccgtgttctgaatcagaagaaaagacttgcaagaccggtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctaatcactctaaccagtgagctcaagtcagctactgtctgcgcttctcacttttgcagttctgccacaagtggtaagaaaagcacggagattcaattccactcaggatcattggttggaaaaacagcaatccacgtcaaaggggcattggtagatggaactgaattcacatttgagggcagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggagaatagagagggcaaccaagatgatgtcaggattgagatggccagacctaggagggtaaggcattggatgtactcgcctgtcatcctgactattctagcaatagggcttgctgagggctgtgatgagatgatccatgctgattctaaacttgtttcgtgcaggcaagggagcggaaatatgaaggaatgtgtcacaactgggagggcgcttcttcctgcggtgaacccagggcaagaggcgtgtctgcacttcacggcacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacacccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggtatagagctacgggtggatgacgctgtgtgctactccaagatcactagtgtggaggcagttgcaaactactccgccatacccaccactattggggggctgaggtttgagagaagccatgacagccagggtaaaatatctggtagccccctggacatcacagctattagaggatctttttctgtcaattatagaggccttcgactgagtctctcagaaatcactgctacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactaaactgtgggggacatgagagtcaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgattggggtcctactggggggattggctctctttttcttgatcatgtctttgtttaagctgggaacaaaacagatatttcgatcgaggacaaagctggcttag

SEQ ID NO: 4842 - RNA, 3222 nt, synthetic construct
  misc_feature 1..3222: note = derived and/or modified CDS sequence (wt) from SFTSV(HNXY_31)__KC292310.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactaccctgctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagctttagccaaagtgaattcccagacatatgcaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgctgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagtctctcagaaatcactgccacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggctggctctctttttcatgattatgtctttgttcaagctgggaacaaaacaggtatttcgatcaaggacgaagctggcttag

SEQ ID NO: 4843 - RNA, 3222 nt, synthetic construct
  misc_feature 1..3222: note = derived and/or modified CDS sequence (wt) from SFTSV/FTLSV(2011YGS5)__KF711925.1__GP
  source 1..3222: mol_type = other RNA
atgatgaaagtcatctggttctcctctctggtctgcttagtcattcaatgcagtggggattcgggcccaatcatctgcgcaggacccatccactcaaacaagagtgctgccataccccacctgcttggttactctgagaagatttgtcagatagatcggctgatacatgtttcgtcatggctcaggaaccactcgcaatttcaaggctacgtagggcagcgaggtggacgctctcaggtgagctactacccagctgagaattcttactcgaggtggagtggacttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggcagtgggaagtctaggacagagtcaggagagctctgcagttcagactcagggactagttctggtctactgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgaaggtgagagtctaccccagccctttgatgttgcatggatggatgttggccactctcataaaatcatcatgagggagcacaagaccaaatgggtacaagagagctcatctaaggattttgtgtgctacaaggaagggactggaccttgttctgaatcagaagaaaaggcttgtaagaccagtggatcatgcaggggggacatgcagttttgcaaggtggcaggttgtgaacatggggaggaggcatctgaagccaagtgtagatgctcacttgtgcacaagcctggggaagtcgttgtgtcatatggagggatgcgtgtcagaccaaagtgctatggtttctccagaatgatggcaacaatggaggtgaacccaccagagcaaaggattggtcaatgcactggctgccatctagaatgcataaatgggggtgtgagactaatcactctaaccagtgagctcaagtcagctactgtctgtgcttcccacttctgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtaatgcagtggactgcacattctgtcgtgagtttctaaaaaatcctcagtgctaccctgcaaagaagtggctgttcatcattattgtcatcctccttggatatgcaggcctcatgctactcaccaatgtccttaaggcaattggggtctgggggtcatgggtgatagctccagtgaagctaatgtttgccatcatgaagaaactaatgagaactgtgagctgcttggtggggaaattgatggataggggaaggcaagtgatccatgaggaaataggggagaatggggagggcaaccatgatgatgttaggattgagatggcaagacccagaagggtaaggcattggatgtactcacctgtcatcctgaccattctagcaatagggcttgctgagggctgtgatgagatggtccatgctgattctaaacttgtttcatgcaggcaagggagcggaaatatgaaggaatgcgtcacaactgggagggcgcttcttcctgcggtgaatccaggacaagaggcgtgtctgcacttcacggcacctgggagtccggactcaaaatgtctcaaaattaaggtcaagaggatcaacctaaaatgtaagaagtcatcatcatattttgttcctgatgcccggaacaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggatgctttaatgcggccccttcatgcatcttctggaggaaatgggtggagaattcacatgggatcatctggaaagtatctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaagaagctggcattagctccctgcaaccaggctggcatgggggttgtaggcaaggttggagagatacagtgcagtagcgaggagagtgcccgtaccataaaaaaagatgggtgtatatggaatgcagacctcgtgggaatagagctacgagtggatgacgctgtgtgctactctaagattactagtgtggaggcagttgcaaactactctgccatacctaccactattggggggctgaggtttgagagaagccatgacagccagggtaaaatatctggtagccccctggacatcacagctataagaggatccttttctgtaaattatagaggccttcgattaagtctctcagaaattactgctacttgcacaggggaggtgacaaatgtgagtgggtgttattcttgcatgacaggggccaaagtctccatcaaattgcatagcagcaaaaatagcactgcccatgttagatgcaaaggggatgagactgcattcagtgttttggagggagtccatagctacactgtcagcctcagctttgaccatgcagtagtcgatgagcagtgccaactgaactgtgggggacatgagagtcaagtgactctaaagggcaacctcatcttcctggatgtcccaaaatttgtggatggcagctacatgcagacatatcacagtactgtgcccacaggggcaaacatcccaagccctacagattggctgaatgccttgtttggcaatgggctgagtaggtggatcctgggggtgataggggttctactggggggattggctctctttttcttgatcatgtttttgttcaagctgggaacaaaacaggtgtttcgatcgaggacgaagctggcttag

SEQ ID NO: 4844 - RNA, 3222 nt, synthetic construct
  misc_feature 1..3222: note = derived and/or modified CDS sequence (wt) from SFTSV/FTLSV(2011YGS7)__KF711922.1__GP
  source 1..3222: mol_type = other RNA
atgatgaaagtcatctggttctcctctctggtctgcttagtcattcaatgcagtggggattcgggcccaatcatctgcgcaggacccatccactcaaacaagagtgctgccataccccacctgcttggttactctgagaagatttgtcagatagatcggctgatacatgtttcgtcatggctcaggaaccactcgcaatttcaaggctacgtagggcagcgaggtggacgctctcaggtgagctactacccagctgagaattcttactcgaggtggagtggacttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggcagtgggaagtctaggacagagtcaggagagctctgcagttcagactcagggactagttctggtctactgccctcggatagggttctctggataggtgatgttgcttgtcagcctatgacacccatccctgaggagacatttctggagctgaagagttttagccaaagtgaattcccagacatatgtaaaattgatggcattgtgttctaccagtgtgagggtgagagtctaccccagccctttgatgttgcatggatggatgttggccactctcataaaatcatcatgagggagcacaagaccaaatgggtacaagagagctcatctaaggattttgtgtgctacaaggaagggactggaccttgttctgaatcagaagaaaaggcttgtaagaccagtggatcatgcaggggggacatgcagttttgcaaggtggcaggttgtgaacatggggaggaggcatctgaagccaagtgtagatgctcacttgtgcacaagcctggggaagtcgttgtgtcatatggagggatgcgtgtcagaccaaagtgctatggtttctccagaatgatggcaacaatggaggtgaacccaccagagcaaaggattggtcaatgcactggctgccatctagaatgcataaatgggggtgtgagactaatcactctaaccagtgagctcaagtcagctactgtctgtgcttcccacttctgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtaatgcagtggactgcacattctgtcgtgagtttctaaaaaatcctcagtgctaccctgcaaagaagtggctgttcatcattattgtcatcctccttggatatgcaggcctcatgctactcaccaatgtccttaaggcaattggggtctgggggtcatgggtgatagctccagtgaagctaatgtttgccatcatgaagaaactaatgagaactgtgagctgcttggtggggaaattgatggataggggaaggcaagtgatccatgaggaaataggggagaatggggagggcaaccatgatgatgttaggattgagatggcaagacccagaagggtaaggcattggatgtactcacctgtcatcctgaccattctagcaatagggcttgctgagggctgtgatgagatggtccatgctgattctaaacttgtttcatgcaggcaagggagcggaaatatgaaggaatgcgtcacaactgggagggcgcttcttccttcggtgaatccaggacaagaggcgtgtctgcacttcacggcacctgggagtccggactcaaaatgtctcaaaattaaggtcaagaggatcaacctaaaatgtaagaagtcatcatcatattttgttcctgatgcccggaacaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggatgctttaatgcggccccttcatgcatcttctggaggaaatgggtggagaattcacatgggatcatctggaaagtatctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaagaagctggcattagctccctgcaaccaggctggcatgggggttgtaggcaaggttggagagatacagtgcagtagcgaggagagtgcccgtaccataaaaaaagatgggtgtatatggaatgcagacctcgtgggaatagagctacgagtggatgacgctgtgtgctactctaagattactagtgtggaggcagttgcaaactactctgccatacctaccactattggggggctgaggtttgagagaagccatgacagccagggtaaaatatctggtagccccctggacatcacagctataagaggatccttttctgtaaattatagaggccttcgattaagtctctcagaaattactgctacttgcacaggggaggtgacaaatgtgagtgggtgttattcttgcatgacaggcgccaaagtctccatcaaattgcatagcagcaaaaatagcactgcccatgttagatgcaaaggggatgagactgcattcagtgttttggagggagtccatagctacactgtcagcctcagctttgaccatgcagtagtcgatgagcagtgccaactgaactgtgggggacatgagagtcaagtgactctaaagggcaacctcatcttcctggatgtcccaaaatttgtggatggcagctacatgcagacatatcacagtactgtgcccacaggggcaaacatcccaagccctacagattggctgaatgccttgtttggcaatgggctgagtaggtggatcctgggggtgataggggttctactggggggattggctctctttttcttgatcatgtttttgttcaagctgggaacaaaacaggtgtttcgatcgaggacgaagctggcttag

SEQ ID NO: 4845 - RNA, 3222 nt, synthetic construct
  misc_feature 1..3222: note = derived and/or modified CDS sequence (wt) from SFTSV/FTLSV(2011YPQ11)__KF711926.1__GP
  source 1..3222: mol_type = other RNA
atgatgaaagtcatctggttctcctctctggtctgcttagtcattcaatgcagtggggattcgggcccaatcatctgcgcaggacccatccactcaaacaagagtgctgccataccccacctgcttggttactctgagaagatttgtcagatagatcggctgatacatgtttcgtcatggctcaggaaccactcgcaatttcaaggctacgtagggcagcgaggtggacgctctcaggtgagctactacccagctgagaattcttactcgaggtggagtggacttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggcagtgggaagtctaggacagagtcaggagagctctgcagttcagactcagggactagttctggtctactgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataaaatcatcatgagggagcacaagaccaaatgggtacaagagagctcatctaaggattttgtgtgctacaaggaagggactggaccttgttctgaatcagaagaaaaggcttgtaagaccagtggatcatgcaggggggacatgcagttttgcaaggtggcaggttgtgaacatggggaggaggcatctgaagccaagtgtagatgctcacttgtgcacaagcctggggaagtcgttgtgtcatatggagggatgcgtgtcagaccaaagtgctatggtttctccagaatgatggcaacaatggaggtgaacccaccagagcaaaggattggtcaatgcactggctgccatctagaatgcataaatgggggtgtgagactaatcactctaaccagtgagctcaagtcagctactgtctgtgcttcccacttctgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtaatgcagtggactgcacattctgtcgtgagtttctaaaaaatcctcagtgctaccctgcaaagaagtggctgttcatcattattgtcatcctccttggatatgcaggcctcatgctactcaccaatgtccttaaggcaattggggtctgggggtcatgggtgatagctccagtgaagctaatgtttgccatcatgaagaaactaatgagaactgtgagctgcttggtggggaaattgatggataggggaaggcaagtgatccatgaggaaataggggagaatggggagggcaaccatgatgatgttaggattgagatggcaagacccagaagggtaaggcattggatgtactcacctgtcatcctgaccattctagcaatagggcttgctgagggctgtgatgagatggtccatgctgattctaaacttgtttcatgcaggcaagggagcggaaatatgaaggaatgcgtcacaactgggagggcgcttcttccttcggtgaatccaggacaagaggcgtgtctgcacttcacggcacctgggagtccggactcaaaatgtctcaaaattaaggtcaagaggatcaacctaaaatgtaagaagtcatcatcatattttgttcctgatgcccggtacaggtgtacatcagtgaggagatgtccatgggcgggagactgccagtctgggtgcccccctcatttcacatccaactccttttctgatgattgggcaggtaagatggacagggctggtcttggattcagtggctgctctgatggatgtggaggagcagcctgcggatgctttaatgcggccccttcatgcatcttctggaggaaatgggtggagaattcacatgggatcatctggaaagtatctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaagaagctggcattagctccctgcaaccaggctggcatgggggttgtaggcaaggttggagagatacagtgcagtagcgaggagagtgcccgtaccataaaaaaagatgggtgtatatggaatgcagacctcgtgggaatagagctacgagtggatgacgctgtgtgctactctaagattactagtgtggaggcagttgcaaactactctgccatacctaccactattggggggctgaggtttgagagaagccatgacagccagggtaaaatatctggtagccccctggacatcacagctataagaggatccttttctgtaaattatagaggccttcgattaagtctctcagaaattactgctacttgcacaggggaggtgacaaatgtgagtgggtgttattcttgcatgacaggcgccaaagtctccatcaaattgcatagcagcaaaaatagcactgcccatgttagatgcaaaggggatgagactgcattcagtgttttggagggagtccatagctacactgtcagcctcagctttgaccatgcagtagtcgatgagcagtgccaactgaactgtgggggacatgagagtcaagtgactctaaagggcaacctcatcttcctggatgtcccaaaatttgtggatggcagctacatgcagacatatcacagtactgtgcccacaggggcaaacatcccaagccctacagattggctgaatgccttgtttggcaatgggatgagtaggtggatcctgggggtgataggggttctactggggggattggctctctttttcttgatcatgtttttgttcaagctgggaacaaaacaggtgtttcgatcgaggacgaagctggcttag

SEQ ID NO: 4846 - RNA, 3222 nt, synthetic construct
  misc_feature 1..3222: note = derived and/or modified CDS sequence (wt) from SFTSV/FTLSV(2011YPQ12)__KF711930.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcaaatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctaatcactctaaccagtgagctcaagtcagctactgtctgcgcttctcacttttgcagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctggcaatagggcttgctgagggctgtgatgagatggtccatgctgattctaaacttgtttcgtgcaggcaggggagcggaaatatgaaggaatgtgtcacaactgggagggcgcttcttcctgcggtgaacccagggcaagaggcgtgtctgcacttcacggcacctggaagtccggactcaaaatgtctcaaaattaaggttaagaggatcaacctaaaatgtaaaaagtcatcatcatattttgttcctgttgcccggtacaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggtatagagctacgggtggatgacgctgtgtgctactctaagatcactagtgtggaggcagttgcaaactactccgccatacccaccactattggggggctgaggtttgagagaagccatgacagccagggtaaaatatctggtagccccctggacatcacagctataagaggatctttttctgtcaattatagaggccttcgactgagtctctcagaaatcactgctacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtctttgtttaagctgggaacaaaacagatatttcgatcgaggacaaagctggcttag

SEQ ID NO: 4847 - RNA, 3222 nt, synthetic construct
  misc_feature 1..3222: note = derived and/or modified CDS sequence (wt) from SFTSV/FTLSV(2011YPQ17)__KF711923.1__GP
  source 1..3222: mol_type = other RNA
atgatgaaagtcatctggttctcctctctggtctgcttagtcattcaatgcagtggggattcgggcccaatcatctgcgcaggacccatccactcaaacaagagtgctgccataccccacctgcttggttactctgagaagatttgtcagatagatcggctgatacatgtttcgtcatggctcaggaaccactcgcaatttcaaggctacgtagggcagcgaggtggacgctctcaggtgagctactacccagctgagaattcttactcgaggtggagtggacttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggcagtgggaagtctaggacagagtcaggagagctctgcagttcagactcagggactagttctggtctactgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataaaatcatcatgagggagcacaagaccaaatgggtacaagagagctcatctaaggattttgtgtgctacaaggaagggactggaccttgttctgaatcagaagaaaaggcttgtaagaccagtggatcatgcaggggggacatgcagttttgcaaggtggcaggttgtgaacatggggaggaggcatctgaagccaagtgtagatgctcacttgtgcacaagcctggggaagtcgttgtgtcatatggagggatgcgtgtcagaccaaagtgctatggtttctccagaatgatggcaacaatggaggtgaacccaccagagcaaaggattggtcaatgcactggctgccatctagaatgcataaatgggggtgtgagactaatcactctaaccagtgagctcaagtcagctactgtctgtgcttcccacttctgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtaatgcattggactgcacattctgtcgtgagtttctaaaaaatcctcattgctaccctgcaaagaagtggctgttcatcattattgtcatcctccttggatatgcaggcctcatgctactcaccaatgtccttaaggcaattggggtctgggggtcatgggtgatagctccagtgaagctaatgtttgccatcatgaagaaactaatgagaactgtgagctgcttggtggggaaattgatggataggggaaggcaagtgatccatgaggaaataggggagaatggggagggcaaccatgatgatgttaggattgagatggcaagacccagaagggtaaggcattggatgtactcacctgtcatcctgaccattctagcaatagggcttgctgagggctgtgatgagatggtccatgctgattctaaacttgtttcatgcaggcaagggagcggaaatatgaaggaatgcgtcacaactgggagggcgcttcttccttcggtgaatccaggacaagaggcgtgtctgcatttcacggcacctgggagtccggactcaaaatgtctcaaaattaaggtcaagaggatcaacctaaaatgtaagaagtcatcatcatattttgttcctgatgcccggaacaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggatgctttaatgcggccccttcatgcatcttctggaggaaatgggtggagaattcacatgggatcatctggaaagtatctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaagaagctggcattagctccctgcaaccaggctggcatgggggttgtaggcaaggttggagagatacagtgcagtagcgaggagagtgcccgtaccataaaaaaagatgggtgtatatggaatgcagacctcgtgggaatagagctacgagtggatgacgctgtgtgctactctaagattactagtgtggaggcagttgcaaactactctgccatacctaccactattggggggctgaggtttgagagaagccatgacagccagggtaaaatatctggtagccccctggacatcacagctataagaggatccttttctgtaaattatagaggccttcgattaagtctctcagaaattactgctacttgcacaggggaggtgacaaatgtgagtgggtgttattcttgcatgacaggcgccaaagtctccatcaaattgcatagcagcaaaaatagcactgcccatgttagatgcaaaggggatgagactgcattcagtgttttggagggagtccatagctacactgtcagcctcagctttgaccatgcagtagtcgatgagcagtgccaactgaactgtgggggacatgagagtcaagtgactctaaagggcaacctcatcttcctggatgtcccaaaatttgtggatggcagctacatgcagacatatcacagtactgtgcccacaggggcaaacatcccaagccctacagattggctgaatgccttgtttggcaatgggctgagtaggtggatcctgggggtgataggggttctactggggggattggctctctttttcttgatcatgtttttgttcaagctgggaacaaaacaggtgtttcgatcgaggacgaagctggcttag

SEQ ID NO: 4848 - RNA, 3222 nt, synthetic construct
  misc_feature 1..3222: note = derived and/or modified CDS sequence (wt) from SFTSV/FTLSV(2011YSC22)__KF711927.1__GP
  source 1..3222: mol_type = other RNA
atgatgaaagtcatctggttctcctctctggtctgcttagtcattcaatgcagtggggattcgggcccaatcatctgcgcaggacccatccactcaaacaagagtgctgccataccccacctgcttggttactctgagaagatttgtcagatagatcggctgatacatgtttcgtcatggctcaggaaccactcgcaatttcaaggctacgtagggcagcgaggtggacgctctcaggtgagctactacccagctgagaattcttactcgaggtggagtggacttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggcagtgggaagtctaggacagagtcaggagagctctgcagttcagactcagggactagttctggtctactgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgaaggtgagagtctaccccagccctttgatgttgcatggatggatgttggccactctcataaaatcatcatgagggagcacaagaccaaatgggtacaagagagctcatctaaggattttgtgtgctacaaggaagggactggaccttgttctgaatcagaagaaaaggcttgtaagaccagtggatcatgcaggggggacatgcagttttgcaaggtggcaggttgtgaacatggggaggaggcatctgaagccaagtgtagatgctcacttgtgcacaagcctggggaagtcgttgtgtcatatggagggatgcgtgtcagaccaaagtgctatggtttctccagaatgatggcaacaatggaggtgaacccaccagagcaaaggattggtcaatgcactggctgccatctagaatgcataaatgggggtgtgagactaatcactctaaccagtgagctcaagtcagctactgtctgtgcttcccacttctgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtaatgcagtggactgcacattctgtcgtgagtttctaaaaaatcctcagtgctaccctgcaaagaagtggctgttcatcattattgtcatcctccttggatatgcaggcctcatgctactcaccaatgtccttaaggcaattggggtctgggggtcatgggtgatagctccagtgaagctaatgtttgccatcatgaagaaactaatgagaactgtgagctgcttggtggggaaattgatggataggggaaggcaagtgatccatgaggaaataggggagaatggggagggcaaccatgatgatgttaggattgagatggcaagacccagaagggtaaggcattggatgtactcacctgtcatcctgaccattctagcaatagggcttgctgagggctgtgatgagatggtccatgctgattctaaacttgtttcatgcaggcaagggagcggaaatatgaaggaatgcgtcacaactgggagggcgcttcttccttcggtgaatccaggacaagaggcgtgtctgcacttcacggcacctgggagtccggactcaaaatgtctcaaaattaaggtcaagaggatcaacgtaaaatgtaagaagtcatcatcatattttgttcctgatgcccggaacaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggatgctttaatgcggccccttcatgcatcttctggaggaaatgggtggagaattcacatgggatcatctggaaagtatctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaagaagctggcattagctccctgcaaccaggctggcatgggggttgtaggcaaggttggagagatacagtgcagtagcgaggagagtgcccgtaccataaaaaaagatgggtgtatatggaatgcagacctcgtgggaatagagctacgagtggatgacgctgtgtgctactctaagattactagtgtggaggcagttgcaaactactctgccatacctaccactattggggggctgaggtttgagagaagccatgacagccagggtaaaatatctggtagccccctggacatcacagctataagaggatccttttctgtaaattatagaggccttcgattaagtctctcagaaattactgctacttgcacaggggaggtgacaaatgtgagtgggtgttattcttgcatgacaggcgccaaagtctccatcaaattgcatagcagcaaaaatagcactgcccatgttagatgcaaaggggatgagactgcattcagtgttttggagggagtccatagctacactgtcagcctcagctttgaccatgcagtagtcgatgagcagtgccaactgaactgtgggggacatgagagtcaagtgactctaaagggcaacctcatcttcctggatgtcccaaaatttgtggatggcagctacatgcagacatatcacagtactgtgcccacaggggcaaacatcccaagccctacagattggctgaatgccttgttgggcaatgggatgagtaggtggatcctgggggtgataggggttctactggggggattggctctctttttcttgatcatgtttttgttcaagctgggaacaaaacaggtgtttcgatcgaggacgaagctggcttag

SEQ ID NO: 4849 - RNA, 3222 nt, synthetic construct
  misc_feature 1..3222: note = derived and/or modified CDS sequence (wt) from SFTSV/FTLSV(2011YSC60)__KF711945.1__GP
  source 1..3222: mol_type = other RNA
atgatgaaagtcatctggttctcctctctgatctgcttagtcattcaatgcggtggggatacgggcccaatcatctgcgcaggacccatccactcaaacaagagtgctgacataccccacctgcttggctactctgagaagatttgtcagatagatcggctgatacatgtttcgtcttggcttagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactccgggactagttctggtcttctgccctcggatagggttctctggataggtgatgttgcttgtcagccaatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcacaaaatcatcatgagggagtacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcagaattaaggttaagaggatcaacctaaaatgtaagaagtcatcatcatattttgttcctgatgcccggaacagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccacgattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtaactctaaaaggcaaccttatcttcctggatgtcccaaaatttgtggatggcagctacatgcagacatatcatagcactgtgcccacaggggcaaacatcccaagtccaacagactggctgaatgccttgtttggcaatgggctgagtaggtgggtcctgggggtgatgggggttctgcttgggggattggctctctttttcatgatcatgtctttgttcaagctgggaacaaaacaggtatttcgatcaaggacaaagctggcttaa

SEQ ID NO: 4850 - RNA, 3222 nt, synthetic construct
  misc_feature 1..3222: note = derived and/or modified CDS sequence (wt) from SFTSV/FTLSV(2011YSH45)__KF711947.1__GP
  source 1..3222: mol_type = other RNA
atgatgaaagtcatctggttctcctctctgatctgctttgtcattcaatgcagtggggactcgggcccaatcatctgcgcaggacctatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccctcatacaaggggaaagtcttttttgagcgaccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatactgactattttagcaatagggcttgctgagagctgtgatgagatggtccatgctgattccaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctagaatgtaagaagtcatcatcatattttgttcctgatgcccggaacagatgtacatcagtgaggagatgtcgttgggctggagactgccagtctgggtgcccccctcatttcacatctaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgcgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcagaaatagcactgcccatgtaagatgcaaaggggatgagactgcattcagtgttttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtgggtcctgggggtgatgggggttctgcttgggggattggctctctttttcatgatcatgtctttgttcaagctgggaacaaaacaggtatttcgatcaaggacaaagctggcttag

SEQ ID NO: 4851 - RNA, 3222 nt, synthetic construct
  misc_feature 1..3222: note = derived and/or modified CDS sequence (wt) from SFTSV/FTLSV(2011YSH52)__KF711928.1__GP
  source 1..3222: mol_type = other RNA
atgatgaaagtcatctggttctcctctctgatctgcttagtcattcaatgcggtggggatacgggcccaatcatctgcgcaggacccatccactcaaacaagagtgctgacataccccacctgcttggctactctgagaagatttgtcagatagatcggctgatacatgtttcgtcttggcttagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactccgggactagttctggtcttctgccctcggatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctaccccagccctttgatgttgcatggatggatgttggccactctcataaaatcatcatgagggagcataagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctaatcactctaaccagtgagctcaagtcagctactgtctgcgcttctcacttttgcagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcttcatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaagggagcggaaatatgaaggaatgtgtcacaactgggagggcgcttcttcctgcggtgaacccagggcaagaggcgtgtctgcacttcacggcacctggaagtccggactcaaaatgtctcaaaattaaggttaagaggatcaacaaaaaatgtaaaaagtcatcatcatattttgttcctgatgcccggtacaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgtctgatctgtgtgagatagaagagctcaactcaaagaagctcgcattagctccctgcaaccaggctggtatgggggtcgtaggcaaggttggagagatacagtgcagtagcgaggaaagtgcccgtaccataaaaaaagatgggtgcataaggaatgctgacctcgtgggtatagaggtacgcgtggatgacgctgtgttctactttaagatcactagtgtggaggcagttgcaaactactccgccatacccaccactattggggggctgaggtttgagagaagccatgacagccagggtaaaatatctggtagccccctggacatcacagctataagaggatctttttctgtcaattatagaggccttcgactgagtctctcagaaatcactgctacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcttgtctttgtttaagctgggaacaaaacagatatttcgatcgaggacaaagctggcttag

SEQ ID NO: 4852 - RNA, 3222 nt, synthetic construct
  misc_feature 1..3222: note = derived and/or modified CDS sequence (wt) from SFTSV/FTLSV(2011YXX9)__KF711924.1__GP
  source 1..3222: mol_type = other RNA
atgatgaaagtcatctggttctcctctctggtctgcttagtcattcaatgcagtggggattcgggcccaatcatctgcgcaggacccatccactcaaacaagagtgctgccataccccacctgcttggttactctgagaagatttgtcagatagatcggctgatacatgtttcgtcatggctcaggaaccactcgcaatttcaaggctacgtagggcagcgaggtggacgctctcaggtgagctactacccagctgagaattcttactcgaggtggagtggacttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggcagtgggaagtctaggacagagtcaggagagctctgcagttcagactcagggactagttctggtctactgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgggagggtgagagtctaccccagccctttgatgttgcatggatggatgttggccactctcataaaatcatcatgagggagcacaagaccaaatgggtacaagagagctcatctaaggattttgtgtgctacaaggaagggactggaccttgttctgaatcagaagaaaaggcttgtaagaccagtggatcatgcaggggggacatgcagttttgcaaggtggcaggttgtgaacatggggaggaggcatctgaagccaagtgtagatgctcacttgtgcacaagcctggggaagtcgttgtgtcatatggagggatgcgtgtcagaccaaagtgctatggtttctccagaatgatggcaacaatggaggtgaacccaccagagcaaaggattggtcaatgcactggctgccatctagaatgcataaatgggggtgtgagactaatcactctaaccagtgagctcaagtcagctactgtctgtgcttcccacttctgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtaatgcagtggactgcacattctgtcgtgagtttctaaaaaatcctcagtgctaccctgcaaagaagtggctgttcatcattattgtcatcctccttggatatgcaggcctcatgctactcaccaatgtccttaaggcaattggggtctgggggtcatgggtgatagctccagtgaagctaatgtttgccatcatgaagaaactaatgagaactgtgagctgcttggtggggaaattgatggataggggaaggcaagtgatccatgaggaaataggggagaatggggagggcaaccatgatgatgttaggattgagatggcaagacccagaagggtaaggcattggatgtactcacctgtcatcctgaccattctagcaatagggcttgctgagggctgtgatgagatggtccatgctgattctaaacttgtttcatgcaggcaagggagcggaaatatgaaggaatgcgtcacaactgggagggcgcttcttccttcggtgaatccaggacaagaggcgtgtctgcacttcacggcacctgggagtccggactcaaaatgtctcaaaattaaggtcaagaggatcaacctaaaatgtaagaagtcatcatcatattttgttcctgatgcccggaacaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggatgctttaatgcggccccttcatgcatcttctggaggaaatgggtggagaattcacatgggatcatctggaaagtatctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaagaagctggcattagctccctgcaaccaggctggcatgggggttgtaggcaaggttggagagatacagtgcagtagcgaggagagtgcccgtaccataaaaaaagatgggtgtatatggaatgcagacctcgtgggaatagagctacgagtggatgacgctgtgtgctactctaagattactagtgtggaggcagttgcaaactactctgccatacctaccactattggggggctgaggtttgagagaagccatgacagccagggtaaaatatctggtagccccctggacatcacagctataagaggatccttttctgtaaattatagaggccttcgattaagtctctcagaaattactgctacttgcacaggggaggtgacaaatgtgagtgggtgttattcttgcatgacaggcgccaaagtctccatcaaattgcatagcagcaaaaatagcactgcccatgttagatgcaaaggggatgagactgcattcagtgttttggagggagtccatagctacactgtcagcctcagctttgaccatgcagtagtcgatgagcagtgccaactgaactgtgggggacatgagagtcaagtgactctaaagggcaacctcatcttcctggatgtcccaaaatttgtggatggcagctacatgcagacatatcacagtactgtgcccacaggggcaaacatcccaagccctacagattggctgaatgccttgtttggcaatgggctgagtaggtggatcctgggggtgataggggttctactggggggattggctctctttttcttgatcatgtttttgttcaagctgggaacaaaacaggtgtttcgatcgaggacgaagctggcttag

SEQ ID NO: 4853 - RNA, 3222 nt, synthetic construct
  misc_feature 1..3222: note = derived and/or modified CDS sequence (wt) from SFTSV/FTLSV(2012YGS10)__KF711937.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactgttttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4854 - RNA, 3222 nt, synthetic construct
  misc_feature 1..3222: note = derived and/or modified CDS sequence (wt) from SFTSV/FTLSV(2012YGS4)__KF711933.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctggttgcccccctcatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatacccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccaaggtaaaatatctggtatccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4855 - RNA, 3222 nt, synthetic construct
  misc_feature 1..3222: note = derived and/or modified CDS sequence (wt) from SFTSV/FTLSV(2012YSC6)__KF711931.1__GP
  source 1..3222: mol_type = other RNA
atgatgaaagtcatctggttctcctctctgatctgctttgtcattcaatgcagtgggggctcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagcccattgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaacagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatacccacacaagtcttcaagggtgtgagtgtgacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaatgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatctttttctgttaattatagaggccttcgattgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatccctagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4856 - RNA, 3222 nt, synthetic construct
  misc_feature 1..3222: note = derived and/or modified CDS sequence (wt) from SFTSV/FTLSV(2012YSH10)__KF711940.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcaaatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcacaaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccatgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcagaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtaactctaaaaggcaaccttatcttcctggatgtcccaaaatttgtggatggcagctacatgcagacatatcatagcactgtgcccacaggggcaaacatcccaagtccaacagactggctgaatgccttgtttggcaatgggctgagtaggtgggtcctgggggtgatgggggttctgcttgggggattggctctctttttcatgatcatgtctttgttcaagctgggaacaaaacaggtatttcgatcaaggacaaagctggcttag

SEQ ID NO: 4857 - RNA, 3222 nt, synthetic construct
  misc_feature 1..3222: note = derived and/or modified CDS sequence (wt) from SFTSV/FTLSV(2012YSH104)__KF711943.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcaaatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcacaaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtaagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaacgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcagaattaaggttaagaggatcaacctaaaatgtaagaagtcatcatcatattttgttcctgatgcccggtacagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaagctgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtaactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtgggtcctgggggtgatgggggttctgcttgggggattggctctctttttcatgatcatgtctttgttcaagctgggaacaaaacaggtatttcgatcaaggacaaagctggcttag

SEQ ID NO: 4858 - RNA, 3222 nt, synthetic construct
  misc_feature 1..3222: note = derived and/or modified CDS sequence (wt) from SFTSV/FTLSV(2012YSH105)__KF711944.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcaaatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcacaaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagctgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcagaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctggtgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctagcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtaactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtggatcctgggggtgatgggggttctgcttgggggattggctctctttttcatgatcatgtctttgttcaagctgggaacaaaacaggtatttcgatcaaggacaaagctggcttag

SEQ ID NO: 4859 - RNA, 3222 nt, synthetic construct
  misc_feature 1..3222: note = derived and/or modified CDS sequence (wt) from SFTSV/FTLSV(2012YSH107)__KF711942.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcaaatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcacaaaatcatcatgagggagcacaagaccaaatgggtgcaagagagctcatccaaggattttgtgtgctacaaagaagggactgggccttgttctgaatcagaagaaaagactggcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacgactgggagggcgcttcttcctgcggtgaacccaggtcaagaggcatgtctgcacttcacggcacctgggagtccggactcaaaatgtctcagaattaaggttaagaggatcaacctaaaatgtaagaagtcatcatcatattttgttcctgatgcccggtacagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtaactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtgggtcctgggggtgatgggggttctgcttgggggattagctctctttttcatgatcatgtctttgttcaagctgggaacaaaacaggtatttcgatcaaggacaaagctggcttag

SEQ ID NO: 4860 - RNA, 3222 nt, synthetic construct
  misc_feature 1..3222: note = derived and/or modified CDS sequence (wt) from SFTSV/FTLSV(2012YSH14)__KF711938.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgattgttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataattgggggtgtgaggctaataactctaaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtcaaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgagatttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4861 - RNA, 3222 nt, synthetic construct
  misc_feature 1..3222: note = derived and/or modified CDS sequence (wt) from SFTSV/FTLSV(2012YSH16)__KF711934.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctcaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtacagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4862 - RNA, 3222 nt, synthetic construct
  misc_feature 1..3222: note = derived and/or modified CDS sequence (wt) from SFTSV/FTLSV(2012YSH6)__KF711921.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgaaaattcttactcgaggtggaatggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtagcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgccacaagtggtaagaaaagcacggagattcatttccactcaggatcattggttgggaaaacagctatccatgtcaaaggggcattagtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttagtcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggagggcgcttcttcctgcggtgaacccagggcaagaggcatgtctgcacttcacagcacctgggagtccggactcaaaatgtctcaaaattaaggtcaagaggatcaacctaaaatgtaagaagtcatcatcatattttgttcctgatgcccggtccagatgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaatgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaagttgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4863 - RNA, 3222 nt, synthetic construct
  misc_feature 1..3222: note = derived and/or modified CDS sequence (wt) from SFTSV/FTLSV(2012YSH86)__KF711939.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgccatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatgtttgccatcataaagaaactaatgagaactgtgagctgcttgatggggaaattgatggataggggaaggcaagtgatccatgaggagataggggagaatagagagggcaaccaagatgatgtcaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggttcatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtattacgatcaaggacgaagctggcttag

SEQ ID NO: 4864 - RNA, 3222 nt, synthetic construct
  misc_feature 1..3222: note = derived and/or modified CDS sequence (wt) from SFTSV/FTLSV(2012YSH89)__KF711935.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttattctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctcaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccatcccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagcgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgaggctgcattcagtgtcttggagggggtccatagctacactgtcagcctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4865 - RNA, 3222 nt, synthetic construct
  misc_feature 1..3222: note = derived and/or modified CDS sequence (wt) from SFTSV/FTLSV(2012YSH9)__KF711919.1__GP
  source 1..3222: mol_type = other RNA
atgatgaaagtcatctggttctcctctctgatctgcttagtcattcaatgcagtggggactcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcgggttagctactacccagctgagaattcttactcgaggtggagtggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaaccgtccagagcaaaggattggtcaatgcactggctgccatctagaatgcataaatgggggtgtgaggctaatcactctaaccagtgagctcaggtcagctactgtctgtgcttcccacttttgcagttctgccacaagtggtaagaaaaacacggagattcatttccactcaggatcattggttgggaaaacagctatccatgtcaaaggggcattggtagatgggactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgtcaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggagggcgcttcttcctgcggtgaacccagggcaagaggcatgtctgcacttcacagcacctgggagtccggactcaaaatgtctcaaaattaaggtcaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggtggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaatgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4866 - RNA, 3222 nt, synthetic construct
  misc_feature 1..3222: note = derived and/or modified CDS sequence (wt) from SFTSV/FTLSV(2012YSH91)__KF711920.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccatgaggagacatttctggagctgaagagttttagccaaagtgaattcccagacatatgtaagattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagagaaggcatctgagaccaagtgtagatgctcacttgtgcacaagcctggggaagtcgttgtgtcatatggagggatgcgtgtcagaccaaagtgctacggtatctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacataaaatgtaagaagtcatcatcatattttgttcgtgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagaaacagtgcagtagcgaggagagtgcccgtaccataaaaaaagatgggtgcatatggaacgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4867 - RNA, 3222 nt, synthetic construct
  misc_feature 1..3222: note = derived and/or modified CDS sequence (wt) from SFTSV/FTLSV(2012YSH92)__KF711941.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattctcactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcaaatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcacaaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatcctcagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacgactgggagggcgcttcttcctgcggtgaacccaggtcaagaggcatgtctgcacttcacggcacctgggagtccggactcaaaatgtctcagaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgatgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtaactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtgggtcctgggggtgatgggggttctgcttgggggattggctctctttttcatgatcatgtctttgttcaagctgggaacaaaacaggtatttcgatcaaggacaaagctggcttag

SEQ ID NO: 4868 - RNA, 3222 nt, synthetic construct
  misc_feature 1..3222: note = derived and/or modified CDS sequence (wt) from SFTSV/FTLSV(2012YSH93)__KF711946.1__GP
  source 1..3222: mol_type = other RNA
atgatgaaagtcatctggttctcctctctgatctgctttgtcattcaatgcagtggggactcgggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcaaatagggttctctggataggtgatgttgcttgtcagcctatgacacccatccctgaggagacatttctggagctgaagagtttcagccaaagtgaattcccagacatatgcaaaattgatggcattgtattcaaccagtgtgagggtgagagcctaccccagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaacgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtacagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtgggtcctgggggtgatgggggttctgcttgggggattggctctctttttcatgatcatgtctttgttcaagctgggaacaaaacaggtatttcgatcaaggacaaagctggcttag

SEQ ID NO: 4869 - RNA, 3222 nt, synthetic construct
  misc_feature 1..3222: note = derived and/or modified CDS sequence (wt) from SFTSV/FTLSV(YGS1)__KF356537.1__GP
  source 1..3222: mol_type = other RNA
atgatgaaagtcatctggttctcctctctggtctgcttagtcattcaatgcagtggggattcgggcccaatcatctgcgcaggacccatccactcaaacaagagtgctgccataccccacctgcttggttactctgagaagatttgtcagatagatcggctgatacatgtttcgtcatggctcaggaaccactcgcaatttcaaggctacgtagggcagcgaggtggacgctctcaggtgagctactacccagctgagaattcttactcgaggtggagtggacttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggcagtgggaagtctaggacagagtcaggagagctctgcagttcagactcagggactagttctggtctactgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataaaatcatcatgagggagcacaagaccaaatgggtacaagagagctcatctaaggattttgtgtgctacaaggaagggactggaccttgttctgaatcagaagaaaaggcttgtaagaccagtggatcatgcaggggggacatgcagttttgcaaggtggcaggttgtgaacatggggaggaggcatctgaagccaagtgtagatgctcacttgtgcacaagcctggggaagtcgttgtgtcatatggagggatgcgtgtcagaccaaagtgctatggtttctccagaatgatggcaacaatggaggtgaacccaccagagcaaaggattggtcaatgcactggctgccatctagaatgcataaatgggggtgtgagactaatcactctaaccagtgagctcaagtcagctactgtctgtgcttcccacttctgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtaatgcagtggactgcacattctgtcgtgagtttctaaaaaatcctcagtgctaccctgcaaagaagtggctgttcatcattattgtcatcctccttggatatgcaggcctcatgctactcaccaatgtccttaaggcaattggggtctgggggtcatgggtgatagctccagtgaagctaatgtttgccatcatgaagaaactaatgagaactgtgagctgcttggtggggaaattgatggataggggaaggcaagtgatccatgaggaaataggggagaatggggagggcaaccatgatgatgttaggattgagatggcaagacccagaagggtaaggcattggatgtactcacctgtcatcctgaccattctagcaatagggcttgctgagggctgtgatgagatggtccatgctgattctaaacttgtttcatgcaggcaagggagcggaaatatgaaggaatgcgtcacaactgggagggcgcttcttccttcggtgaatccaggacaagaggcgtgtctgcacttcacggcacctgggagtccggactcaaaatgtctcaaaattaaggtcaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggatgctttaatgcggccccttcatgcatcttctggaggaaatgggtggagaattcacatgggatcatctggaaagtatctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtatctggcttgactgacctgtgtgagatagaagagctcaagtccaagaagctggcattagctccctgcaaccaggctggcatgggggttgtaggcaaggttggagagatacagtgcagtagcgaggagagtgcccgtaccataaaaaaagatgggtgtatatggaatgcagacctcgtgggaatagagctacgagtggatgacgctgtgtgctactctaagattactagtgtggaggcagttgcaaactactctgccatacctaccactattggggggctgaggtttgagagaagccatgacagccagggtaaaatatctggtagccccctggacatcacagctataagaggatccttttctgtaaattatagaggccttcgattaagtctctcagaaattactgctacttgcacaggggaggtgacaaatgtgagtgggtgttattcttgcatgacaggcgccaaagtctccatcaaattgcatagcagcaaaaatagcactgcccatgttagatgcaaaggggatgagactgcattcagtgttttggagggagtccatagctacactgtcagcctcagctttgaccatgcagtagtcgatgagcagtgccaactgaactgtgggggacatgagagtcaagtgactctaaagggcaacctcatcttcctggatgtcccaaaatttgtggatggcagctacatgcagacatatcacagtactgtgcccacaggggcaaacatcccaagccctacagattggctgaatgccttgtttggcaatgggctgagtaggtggatcctgggggtgataggggttctactggggggattggctctctttttcttgatcatgtttttgttcaagctgggaacaaaacaggtgtttcgatcgaggacgaagctggcttag

SEQ ID NO: 4870 - RNA, 3222 nt, synthetic construct
  misc_feature 1..3222: note = derived and/or modified CDS sequence (wt) from SFTSV/FTLSV(YNY1)__KF356538.1__GP
  source 1..3222: mol_type = other RNA
atgatgaaagtcatctggttctcctctctgatctgctttgtcattcaatgcagtggggactcgggcccaatcatctgcgcaggacctatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcgaccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaggagacatttctggagctgaagagttttagccaaagtgaattcccagacatatgcaaaattgatggcattgtattcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaggccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcaccttctgtcgtgagtttctaaaaaatccccagtgctaccctgcaaagaagtggctgttcatcattattgtcatcctctttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcttgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggccggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccttggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaacatcccaagcccaacagactggctgaatgctttgtttggcaatgggctgagtaggtggatcctgggggtgatgggggttctgcttgggggattggctctctttttcatgatcatgtctttgttcaagctgggaacaaaacaggtatttcgatcaaggacaaagctggcttag

SEQ ID NO: 4871 - RNA, 3222 nt, synthetic construct
  misc_feature 1..3222: note = derived and/or modified CDS sequence (wt) from SFTSV/FTLSV(YPQ133)__KF356530.1__GP
  source 1..3222: mol_type = other RNA
atgatgaaagtcatctggttctcctctctgatctgctttgtcattcaatgcagtggggactcgagcccaatcatctgcgcaggacccatccactcaaacaagagtgctgacatacctcacctgctgggttactctgaaaagatatgtcagatagatcggctgatacatgtttcgtcatggctcagaaaccactcacaatttcagggctacgttgggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtttacctcagccctttgatgttgcatggatggatgttggccactctcaaaaaatcatcatgagagagcacaagaccaaatgggtgcaagagagctcatccaaggactttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaagaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaagacaagtgatccatgaggagataggggagaatagagagggcaaccaagatgatgttaggattgagatggcaagacccaggagggtaaggcattggatgtactcacctgtcatcctgaccattttagcaatagggcttgctgagagctgtgatgagatggtccatgctgattctaagcttgtttcatgcaggcaagggagcggaaatatgaaggaatgtgtcacaactgggagggcgcttcttcctgcagtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggcaggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatggggtcatctggaaagtatctccttgtgccgcatgggtcccttcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcggaccttgtgggcatagagctacgagtggatgacgctgtgtgctactctaagatcactagtgtggaagcagttgcaaactactctgccatacccaccactattggggggctgagatttgagagaagccatgacagccagggtaaaatatctggtagccccctggacatcacagctataagaggatctttttctgttaattatagaggccttcgactgagcctctcagaaattactgcaacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtcttagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaacatcccaagcccaacagactggctgaatgccttgtttggcaatgggctgagtaggtggatcctgggggtgatgggggttctgcttgggggattggctctctttttcatgatcatgtctttgttcaagctgggaacaaaacaggtatttcgatcaaggacaaagctggcttag

SEQ ID NO: 4872 - RNA, 3222 nt, synthetic construct
  misc_feature 1..3222: note = derived and/or modified CDS sequence (wt) from SFTSV/FTLSV(YPQ2)__KF356531.1__GP
  source 1..3222: mol_type = other RNA
atgatgaaagtcatctggttctcctctctgatctgctttgtcattcaatgcagtggggactcgggcccaatcatctgcgcaggacctatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcgaccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctgcctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaatagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagagtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctatggcccggttcagatgtacatcagtgaggagatgtcgttgggctggagactgccagtctgggtgcccccctcatttcacatccaactccttttctgatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccaggttaaaatatctggtagccccctggacatcacagctatgagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcttggatgtcccaaaatttgtggatggcagctacatgcagacatatcatagcactgtgcccacaggggcaaacatcccaagcccaacagactggctgaatgccttgtttggcaatgggctgagtaggtggatcctgggggtgatgggggttctgcttgggggattggctctctttttcatgatcatgtctttgttcaagctgggaacaaaacaggtatttcgatcaaggacaaagctggcttag

SEQ ID NO: 4873 - RNA, 3222 nt, synthetic construct
  misc_feature 1..3222: note = derived and/or modified CDS sequence (wt) from SFTSV/FTLSV(YPQ5)__KF356532.1__GP
  source 1..3222: mol_type = other RNA
atgatgaaagtcatctggttctcctctctgatctgctttgtcattcaatgcagtggggactcgggcccaatcatctgcgcaggacccatccactcaaacaaaagtgctgacatacctcacctgctgggttactctgagaagatatgtcagatagatcggctgatacatgtttcgtcatggctcagaaaccactcacaatttcagggctacgtagggcagcgaggtggacgctctcgggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggctgtggcagtgggaagtccaggacagagtcaggagagctctgcagttcagactcagggactagctctggtcttctgccctcagatagggttctctggataggtgatgttgcttgtcagcccatgacacccatccctgaggagacatttctggagctgaagagttttagccaaagtgaattcccagacatatgcaaaattgatggcattgtgttcaaccagtgtgagggtgagagtttacctcagccctttgatgttgcatggatggatgttggccactctcacaaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttcccacttttgtagttctgccacgagtggcaagaagagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccaggagggtgaggcattggatgtactcacctgtcatcctgactattttggcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgttgcccggtacagatgtacatcagtgaggagatgtcgttgggctggagactgccagtctgggtgcccccctcatttcacatccaactccttttctaatgattgggcaggtaagatggacagggctggtctagggttcagtggttgctctgatggatgtggaggagcagcctgcggctgctttaatgcagccccttcatgcatcttctggaggaaatgggtagagaatccacatgggatcatctggaaagtatctccttgtgccgcatgggtcccatcggcagtcatagagttaacaatgccctcaggggaggtgaggacattccaccccatgagtggcatccccacacaagtcttcaagggtgtgagtgtgacttacttgggctcatatatggaggtatctggcttgactgacctatgtgagatagaggagctcaggtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagtactgcccatgtaagatgcaaaggggatgagactgcattcagtgtcttggagggagtccatagctacactgtcagtctcagttttgaccatgcagtagtcgatgagcagtgccaactgaactgtgggggacatgagagtcaagtgactctaaaaggcaaccttatctttctggatgtcccaaaatttgtggatggcagctacatgcagacatatcatagcactgtgcccacaggggcaaacatcccaagcccaacagactggctgaatgccttgtttggcaatgggctgagtaggtggatcctgggggtgatgggggttctgcttgggggattggctctctttttcatgatcatgtctttgttcaagctgggaacaaaacaggtatttcggtcaaggacaaagctggcttag

SEQ ID NO: 4874 - RNA, 3222 nt, synthetic construct
  misc_feature 1..3222: note = derived and/or modified CDS sequence (wt) from SFTSV/FTLSV(YSC19)__KF356536.1__GP
  source 1..3222: mol_type = other RNA
atgatgaaagtcatctggttctcctctctggtctgcttagtcattcaatgcagtggggattcgggcccaatcatctgcgcaggacccatccactcaaacaagagtgctgccataccccacctgcttggttactctgagaagatttgtcagatagatcggctgatacatgtttcgtcatggctcaggaaccactcgcaatttcaaggctacgtagggcagcgaggtggacgctctcaggtgagctactacccagctgagaattcttactcgaggtggagtggacttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggcagtgggaagtctaggacagagtcaggagagctctgcagttcagactcagggactagttctggtctactgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctacaaggaagggactggaccttgttctgaatcagaagaaaaggcttgtaagaccagtggatcatgcaggggggacatgcagttttgcaaggtggcaggttgtgaacatggggaggaggcatctgaagccaagtgtagatgctcacttgtgcacaagcctggggaagtcgttgtgtcatatggagggatgcgtgtcagaccaaagtgctatggtttctccagaatgatggcaacaatggaggtgaacccaccagagcaaaggattggtcaatgcactggctgccatctagaatgcataaatgggggtgtgagactaatcactctaaccagtgagctcaagtcagctactgtctgtgcttcccacttctgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtaatgcagtggactgcacattctgtcgtgagtttctaaaaaatcctcagtgctaccctgcaaagaagtggctgttcatcattattgtcatcctccttggatatgcaggcctcatgctactcaccaatgtccttaaggcaattggggtctgggggtcatgggtgatagctccagtgaagctaatgtttgccatcatgaagaaactaatgagaactgtgagctgcttggtggggaaattgatggataggggaaggcaagtgatccatgaggaaataggggagaatggggagggcaaccatgatgatgttaggattgagatggcaagacccagaagggtaaggcattggatgtactcacctgtcatcctgaccattctagcaatagggcttgctgagggctgtgatgagatggtccatgctgattctaaacttgtttcatgcaggcaagggagcggaaatatgaaggaatgcgtcacaactgggagggcgcttcttccttcggtgaatccaggacaagaggcgtgtctgcacttcacggcacctgggagtccggactcaaaatgtctcaaaattaaggtcaagaggatcaacctaaaatgtaagaagtcatcatcatattttgttcctattgcccggaacaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggatgctttaatgcggccccttcatgcatcttctggaggaaatgggtggagaattcacatgggatcatctggaaagtatctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaagaagctggcattagctccctgcaaccaggctggcatgggggttgtaggcaaggttggagagatacagtgcagtagcgaggagagtgcccgtaccataaaaaaagatgggtgtatatggaatgcagacctcgtgggaatagagctacgagtggatgacgctgtgtgctactctaagattactagtgtggaggcagttgcaaactactctgccatacctaccactattggggggctgaggtttgagagaagccatgacagccagggtaaaatatctggtagccccctggacatcacagctataagaggatccttttctgtaaattatagaggccttcgattaagtctctcagaaattactgctacttgcacaggggaggtgacaaatgtgagtgggtgttattcttgcatgacaggcgccaaagtctccatcaaattgcatagcagcaaaaatagcactgcccatgttagatgcaaaggggatgagactgcattcagtgttttggagggagtccatagctacactgtcagcctcagctttgaccatgcagtagtcgatgagcagtgccaactgaactgtgggggacatgagagtcaagtgactctaaagggcaacctcatcttcctggatgtcccaaaatttgtggatggcagctacatgcagacatatcacagtactgtgcccacaggggcaaacatcccaagccctacagattggctgaatgccttgtttggcaatgggctgagtaggtggatcctgggggtgataggggttctactggggggattggctctctttttcttgatcatgtttttgttcaagctgggaacaaaacaggtgtttcgatcgaggacgaagctggcttag

SEQ ID NO: 4875 - RNA, 3222 nt, synthetic construct
  misc_feature 1..3222: note = derived and/or modified CDS sequence (wt) from SFTSV/FTLSV(YSC3)__KF356535.1__GP
  source 1..3222: mol_type = other RNA
atgatgaaagtcatctggttctcctctctggtctgcttagtcattcaatgcagtggggattcgggcccaatcatctgcgcaggacccatccactcaaacaagagtgctgccataccccacctgcttggttactctgagaagatttgtcagatagatcggctgatacatgtttcgtcatggctcaggaaccactcgcaatttcaaggctacgtagggcagcgaggtggacgctctcaggtgagctactacccagctgagaattcttactcgaggtggagtggacttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggcagtgggaagtctaggacagagtcaggagagctctgcagttcagactcagggactagttctggtctactgccctcggatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaaggataaggcattggatgtactcgcctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtctagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagctatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgttcggcaatggactgagtaggtggatcctgggggtgataggggttctacttggggggttggctctctttttcatgattatgtctttgttcaagctgggaacaaaacaggtatttcgatcaaggacgaagctggcttag

SEQ ID NO: 4876 - RNA, 3222 nt, synthetic construct
  misc_feature 1..3222: note = derived and/or modified CDS sequence (wt) from SFTSV/FTLSV(YSH39)__KF356529.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttggaatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccatcagatagggttctctggataggtgatgttgcttgtcagcctatgacacccatccctgaagagacatttatggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtatcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctgaaaaatccccagtgctaccctgcaaagaagtggctgttcatcattattgtcatcctccttgggcatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctaactattttagcaatagggcttgctgagagctgtgatgagatggtccatgctgattctaagcttgtttcatgcaggcaagggagcggaaatatgaaggaatgtgtaacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagtcccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggttcatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4877 - RNA, 3222 nt, synthetic construct
  misc_feature 1..3222: note = derived and/or modified CDS sequence (wt) from SFTSV/FTLSV(YSHX002)__KF356540.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgaaaattcttactcgaggtggaatggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtagcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgccacaagtggtaagaaaagcacggagattcatttccactcaggatcattggttgggaaaacagctatccatgtcaaaggggcattagtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttagtcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggagggcgcttcttcctgcggtgaacccagggcaagaggcatgtctgcacttcacagcacctgggagtccggactcaaaatgtctcaaaattaaggtcaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagaaacagtgcagtagcgaggagagtgcccgtaccataaaaaaagatgggtgcatatggaatgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaagttgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4878 - RNA, 3222 nt, synthetic construct
  misc_feature 1..3222: note = derived and/or modified CDS sequence (wt) from SFTSV/FTLSV(YXX2)__KF356534.1__GP
  source 1..3222: mol_type = other RNA
atgatgaaagtcatctggttctcctctctgatctgcttagtcattcaatgcggtggggatacgggcccaatcatctgcgcaggacccatccactcaaacaagagtgctgacataccccacctgcttggctactctgagaagatttgtcagatagatcggctgatacatgtttcgtcttggcttagaaaccactcacaatttcagggctacgtagggcagcgaggcggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactcggggactagttctggtcttctgccctcggatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctaatcactctaaccagtgagctcaagtcagctactgtctgcgcttctcacttttgcagttctgccacaagtggtaagaaaagcacggagattcaattccactcaggatcattggttgggaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggaaaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaagggagcggaaatatgaaggaatgtgttacaactgggagggcgcttcttcctgcggtgaacccagggcaagaggcgtgtctgcacttcacggcacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatccccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctagtgggtatagagctacgggtggatgacgctgtgtgctactctaagatcactagtgtggaggcagttgcaaactactccgccatacccaccactattggggggctgaggtttgagagaagccatgacagccagggtaaaatatctggtagccccctggacatcacagctataagaggatctttttctgtcaattatagaggccttcgattgagtctctcagaaatcactgccacttgcacaggggaagtgacaaatgtgagtgggtgttattcttgcatgacaggcgccaaagtctccatcaagttgcatagcagcaaaaatagcactgcccatgtaagatgcaaaggggatgagactgcctttagtgtcttggagggagtccatagctactctgtcagtctcagttttgattatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatccctagccctacagattggctaaatgccttgtttggcaatgggctgagtaggtggattctgggggtgataggggtcctactggggggattggctctctttttcttgatcatgtctttgtttaagctgggaacaaaacagatatttcgatcgaggacaaagctggcttag

SEQ ID NO: 4879 - RNA, 3222 nt, synthetic construct
  misc_feature 1..3222: note = derived and/or modified CDS sequence (wt) from SFTSV/Huaiyangshan virus(2010-FQM)__HQ419236.1__GP
  source 1..3222: mol_type = other RNA
atgatgaaagtcatctggttctcctctctgatctgcttagtcattcaatgcggtggggacacgggcccaatcatttgcgcaggacccatccactcaaacaagagtgctgacataccccacctgcttggctactctgagaagatttgtcagatagatcggctgatacatgtttcgtcttggcttagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactccgggactagttctggtcttctgccctcggatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctataaggaagggactgggccgtgttctgaatcagaagaaaaggcttgcaaggccagtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctgatcactctaaccagtgagctcaagtcagctactgtctgcgcttctcacttttgcagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggccttatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaagggagcggaaatatgaaggaatgtgtcacaactgggagggcgcttcttcctgcggtgaacccagggcaagaggcgtgtctgcacttcacggcacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggtatagagctacgggtggatgacgctgtgtgctactctaagatcactagtgtggaggcagttgcaaactactccgccatacccaccactattggggggctgaggtttgagagaagccatgacagccagggtaaaatatctggtagccccctggacatcacagctataagaggatctttttctgtcaattatagaggccttcgactgagtctctcagaaatcactgctacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagtttcgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtttttgtttaagctgggaacaaaacagatatttcgatcgaggacaaagctggcttag

SEQ ID NO: 4880 - RNA, 3222 nt, synthetic construct
  misc_feature 1..3222: note = derived and/or modified CDS sequence (wt) from SFTSV/Huaiyangshan virus(2010-LZR)__HQ419237.1__GP
  source 1..3222: mol_type = other RNA
atgatgaaagtcatctggttctcctctctgatctgcttagtcattcaatgcggtggggatacgggcccaatcatctgcgcaggacccatccactcaaacaagagtgctgacataccccacctgcttggctactctgagaagatttgtcagatagatcggctgatacatgtttcgtcttggcttagaaaccactcacaatttcagggctacgtagggcagcgaggcggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactccgggactagttctggtcttctgccctcggatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctaatcactctaaccagtgagctcaagtcagctactgtctgcgcttctcacttttgcagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattttgtcgtgagtttctaaaaaatccccagtgctaccctgcaaagaagtggctgttcatcattattgtcatcctccttggatatgcaggcctcatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaagggagcggaaatatgaaggaatgtgtcacaactgggagggcgcttcttcctgcggtgaacccagggcaagaggcgtgtctgcacttcacggcacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatctccatgtgccgcatggatcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctagtgggtatagagctacgggtggatgacgctgtgtgctactctaagatcacaagtgtggaggcagttgcaaactactccgccatacccaccactattggggggctgaggtttgagagaagccatgacagccagggtaaaatatctggtagccccctggacatcacagctataagaggatctttttctgtcaattatagaggccttcgactgagtctctcagaaatcactgctacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtctttgtttaagctgggaacaaaacagatatttcgatcgaggacaaagctggcttag

SEQ ID NO: 4881 - RNA, 3222 nt, synthetic construct
  misc_feature 1..3222: note = derived and/or modified CDS sequence (wt) from SFTSV/Huaiyangshan virus(2010-T112)__HQ419238.1__GP
  source 1..3222: mol_type = other RNA
atgatgaaagtcatctggttctcctctctgatctgctttgtcattcaatgcagtggggactcgggcccaatcatctgcgcaggacccatccattcaaacaagagtgctgacatacctcacctgctgggctactctgagaagatatgtcagatagatcggctgatacatgtttcgtcatggctcagaaaccactcacaatttcagggctacgtagggcagcgaggaggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggctgtggcagtggaaagtctaggacagagtcaggagagctctgcagttcagactcagggactagctctggtcttctgccctcagatagggttctctggataggtgatgttgcttgtcagcctatgacacccatccctgaggagacatttctggagctgaagagttttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgttcacaagcccggagaagtcgttgtgtcatatggagggatgcgtgtcagaccaaagtgctatggtttctccagaatgatggcaacactggaggtgaaccaaccagtgcaaaggattggtcaatgcactggctgccatctggaatgcataaatgggggtgtgaggctaataactctaaccagtgagctcaagtcagctactgtctgtgcttcccacttttgtagttctgccacgagtggcaagaaaagcacggagatacaattccactcaggatcattggttgggaaaacagcaatacacgtcaaaggggcattggtagatggaactgaattcacatttgagggtagctgcatgttcccggatggttgtgatgcggtggactgcactttctgtcgtgagtttctaaaaaatcctcagtgctaccctgcaaagaagtggctgttcatcatcattgtcatcctccttggatatgcaggcctcatgctactcaccaatgtcctcaaggcaattggaatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtacgcacctgtcatcctgactattttagcaatggggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgcaagaagtcatcatcatattttgttcctgatgcccggtccagatgtacatcagtgaggagatgtcgttgggctggagactgccagtcagggtgcccccctcatttcacatccaactctttttctgatgattgggcaggcaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgtcgcatgggtcccatcggcagtcatagagctaacaatgccctcaggggaggtgaggacattccaccccatgagtggcatccctacacaagtcttcaagggtgtgagtgtgacttacttgggctcagatatggaggtgtctggcttgactgacttatgtgagatagaggagctcaagtccaagaagctggcattagctccctgcaaccaggctggcatgggggttgtaggcaaggttggagagatacagtgcagcagcgaggaaagtgcccgtaccataaaaaaagatgggtgcatatggaatgcagaccttgtgggcatagagctacgagtggatgatgctgtgtgctactctaagatcactagtgtagaagcagttgcaaactactctgccatacccaccactattggggggctgaggtttgagagaagccatgacagccagggtaaaatatctggtagccctctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaagctgcatagtagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctgcttgggggattggctctctttttcatgatcatgtctttgttcaagctgggaacaaaacaggtatttcgatcaaggacgaagctggcttag

SEQ ID NO: 4882 - RNA, 3222 nt, synthetic construct
  misc_feature 1..3222: note = derived and/or modified CDS sequence (wt) from SFTSV/Huaiyangshan virus(2010-WJ)__HQ419229.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggcaagcgaggtggacgctctcaggtgagctactacctagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccttcggatagggttctctggataggtgatgttgcttgtcagcctatgacaccaatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcttctcacttttgtagttctgccacaagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgttctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacacccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4883 - RNA, 3222 nt, synthetic construct
  misc_feature 1..3222: note = derived and/or modified CDS sequence (wt) from SFTSV/Huaiyangshan virus(2010-WJQ)__HQ419230.1__GP
  source 1..3222: mol_type = other RNA
atgatgaaagtcatctggttctcctctctgatctgcttagtcattcaatgcggtggggatacgggcccaatcatctgcgcaggacccacccactcaaacaagagtgctgacataccccacctgcttggctactctgagaagatttgtcagatagatcggctgatacatgtttcgtcttggcttagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactccgggactagttctggtcttctgccctcagatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctaccccagccctttgatgttgcatggatggatgttggccactctcataaaatcattatgagggagcacaagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctaatcactctaaccagtgagctcaagtcagctactgtctgcgcttctcacttttgcagttctgccacaagtggtaagaaaagcacggagattcaattccactcaggatcattggttggaaaaacagcaatccacgtcaaaggggctttggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaagggagcggaaatatgaaggaatgtgtcacaactgggagggcgcttcttcctgcggtgaacccagggcaagaggcgtgtctgcacttcacggcacctggaagtccggactcaaaatgtctcaaaattaaggttaagaggatcaacctaaaatgtaaaaagtcatcatcatattttgttcctgatgcccggtccgggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggcatgggggttgtaggcaaggttggagagatacagtgcagtagcgaggaaagtgcccgtaccataaaaaaagatgggtgcatatggaatgctgacctcgtgggtatagagctacgggtggatgacgctgtgtgctactctaagatcactagtgtggaggcagttgcaaactactccgccatacccaccactattggggggctgaggtttgagagaagccatgacagccagggtaaaatatctggtagccccctggacatcacagctataagaggatctttttctgtcaattatagaggccttcgactgagtctctcagaaatcactgctacttgcacaggggaagtgaccaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtagatggattctgggggtgataggggtcctactggggggattggctctctttttcttgatcatgtctttgtttaagctgggaacaaaacagatatttcgatcgaggacaaagctggcttag

SEQ ID NO: 4884 - RNA, 3222 nt, synthetic construct
  misc_feature 1..3222: note = derived and/or modified CDS sequence (wt) from SFTSV/Huaiyangshan virus(2010-WSQ)__HQ419235.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaagggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgccacaagtggtaagaaaagcacggagattcatttccactcaggatcattgattgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcatcattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgaggactgtgatgagatggtccatgctgattctaaacttgtttcatgcagacaagggagcggaaatatgaaggaatgcatcacaactgggagggcgcttcttcctgcggtgaacccagggcaagaggcatgtctgcacttcacagcacctgggagtccggactcaaaatgtctcaaaattaaggtcaagaggatcaacctaaaatgtaagaagtcatcatcatattttgttcctgatgcccggtccaggtgtacgtcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaatgcagacctcgtgggtatagagctacgagtggatgacgctgtgtgctactctaagattactagtgtggaggcagttgcaaactactctgccatacccaccactattggggggctgaggtttgagaaaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4885 - RNA, 3222 nt, synthetic construct
  misc_feature 1..3222: note = derived and/or modified CDS sequence (wt) from SFTSV/Huaiyangshan virus(2010-WWG)__HQ419231.1__GP
  source 1..3222: mol_type = other RNA
atgatgaaagtcatctggttctccactctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgagcggccaacttttgatggatatgtaggctggggttgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgtaaggtagcaggttgtgaacatggggaagaggcatctgaagccaagtgtagatgctcacttgtgcacaagcccggagaagtcgttgtgtcatatggagggatgcgtgtcagaccaaagtgctatggtttccccagaatgatggcaacactggaggtgaaccaacctgagcaaaggattggtcaatgcactggctgccatctggaatgcataaatgggggtgtgaggctaataactctaaccagtgagctcaggtcagctactgtctgtgcttcccacttttgtagttctgccacaagtggcaagaaaagcacggagattcaattccactcaggatcattggttgggaaaacagcaatacacgtcaaaggggcattggtagatggaacagaattcacatttgagggtagttgcatgttcccagatggttgtgatgcggtggactgcactttctgtcgtgagtttctaaaaaatccccagtgctaccctgcaaagaagtggctgctcatcattattgtcatcctccttggatatgcaggcctcatgctactcaccaatgtcctcaaggcaattggtatttggggatcatgggtcatagctccagtgaagctaatatttgccatcataaagaaactaatgagagctgtgagctgcttgatggggaaattgatggataggggaaggcaggtgatccatgaggggataggggagaatagagagggcaaccaggatgatgttaggattgagatggcaagacctagaagggtaaggcattggatgtactcacctgtcatcctgactattttagcaatagggcttgctgagagctgtgatgagatggtccatgctgattctaagcttgtctcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtttagggttcagtggctgctctgatgggtgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacctatgtgagatagaggagctcaagtccaagaagctggcattggctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcatagcagcaaaaatagcactgctcatgtaagatgcaaaggggatgagactgcattcagtgtcttggagggggtccatagctacactgtcagtctcagttttgatcatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctgcttggggggttggctctcttttttatgattatgtctttgttcaagctgggaacaaaacaggtatttcgatcaaggacgaagctggcttag

SEQ ID NO: 4886 - RNA, 3222 nt, synthetic construct
  misc_feature 1..3222: note = derived and/or modified CDS sequence (wt) from SFTSV/Huaiyangshan virus(2010-WWX)__HQ419232.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccttctggaatgcataaatgggggtgtgaggctaataactctaaccagtgagctcaagtcagctactgtctgtgcttctcacttttgtagttctgccacgagtggcaagaaaagcacggagattcaattccactcaggatcattggttgggaaaacagcaatacacgtcaaaggggcattgatagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagcagcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttgggctcagatatggaggtgtctggcttgactgacttatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaattacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4887 - RNA, 3222 nt, synthetic construct
  misc_feature 1..3222: note = derived and/or modified CDS sequence (wt) from SFTSV/Huaiyangshan virus(2010-ZGQ)__HQ419233.1__GP
  source 1..3222: mol_type = other RNA
atgatgaaagtcatctggttctcctctctgatctgcttagtcattcaatgcggtggggatacgggcccaatcatctgcgcaggacccacccactcaaacaagagtgctgacataccccacctgcttggctactctgagaagatttgtcagatagatcggctgatacatgtttcgtcttggcttagaaaccactcacaatttcagggctacgtagggcagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactccgggactagttctggtcttctgccctcggatagggttctctggataggtgatgttgcttgtcagccaatgacacccatccctgaggagacatttctggagctgaagagctttagccaaagtgaattcccagacatatgcaaaattgatggcattgtgttcaaccagtgtgagggtgagagtctaccccagccctttgatgttgcatggatggatgttggccactctcataaaatcatcatgagggagcacaagaccaaatgggtacaagagagctcatccaaggattttgtgtgctataaggaagggactgggccgtgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagccaggggaagtcgttgtgtcatatggagggatgcgtgtcagaccaaagtgctatggtttctccagaatgatggcaacactggaggtgagccagccagagcaaaggattggtcaatgcactggctgccatctagaatgcataaatgggggtgtgaggctaatcactctaaccagtgagctcaagtcagctactgtctgcgcttctcacttttgcagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattgttgtcatcctccttggatatgcaggcctcatgctgctcaccaatgttcttaaggcaattggggtttgggggtcatgggtcatagctccagtgaagctagtgtttgccatcataaagaaactgatgagagctgtgagctgcctgatggggaaattgatggataggggaaggcaagtgatccatgaggaaataggggagaatagagagggcaaccaagatgatgtcaggattgagatggccagacccaggagggtaaggcattggatgtactcgcctgtcatcctgactattctagcaatagggcttgctgagggctgtgatgagatggtccatgctgattctaaacttgtttcgtgcaggcaagggagcggaaatatgaaggaatgtgtcacaactgggagggcgcttcttcctgcggtgaacccagggcaagaggcgtgtctgcacttcacggcacctggaagtccagactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgatctgtgtgagatagaagagctcaagtcaaagaagcttgcattagctccctgcaaccaggctggtatgggggttgtaggcaaggttggagagatacagtgcagtagcgaggaaagtgcccgtacaataaaaaaagatgggtgcatatggaatgctgacctcgtgggtatagagctacgggtggatgacgctgtgtgctactctaagatcactagtgtggaggcagttgcaaactactccgccatacccaccactattggggggctgaggtttgagagaagccatgacagccagggtaaaatatctggtagccccctggacatcacagctattagaggatctttttctgtcaattatagaggccttcgactgagtctctcagaaatcactgctacttgcacaggggaagtgacaaatgtgagtgggtgttattcttgcatgacaggcgccaaagtctccatcaagttgcatagcagcaaaaatagcactgcccatgtaaggtgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtctttgtttaagctgggaacaaaacagatatttcgatcgaggacaaagctggcttag

SEQ ID NO: 4888 - RNA, 3222 nt, synthetic construct
  misc_feature 1..3222: note = derived and/or modified CDS sequence (wt) from SFTSV/Huaiyangshan virus(M-HZM)__JF951393.1__GP
  source 1..3222: mol_type = other RNA
atgatgaaagtcatctggttctcctctctgacctgcttagtcattcaatgcagtggggactcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaaccctccagagcaaaggattggtcaatgcactggctgccatctagaatgcataaatgggggtgtgaggctaatcactctaaccagtgagctcaggtcagctactgtctgtgcttcccacttttgcagttctgccacaagtggtaagaaaaacacggagattcatttccactcaggatcattggttgggaaaacagctatccatgtcaaaggggcattggtagatgggactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggagggcgcttcttcctgcggtgaacccagggcaagaggcatgtctgcacttcacagcacctgggagtccggactcaaaatgtctcaaaattaaggtcaagaggatcaacttaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggtggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaatgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaatttaagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4889 - RNA, 3222 nt, synthetic construct
  misc_feature 1..3222: note = derived and/or modified CDS sequence (wt) from SFTSV/Phlebovirus(AH15/China/2010 strain AH15)__HQ141593.1__GP
  source 1..3222: mol_type = other RNA
atgatgaaagtcatctggttcttctctctgatctgcttagtcattcaatgcggtggggatacaggcccaatcatctgcgcaggacccatccactcaaacaagagtgctgacataccccacctgcttggctactctgagaagatttgtcagatagatcggctgatacatgtttcgtcatggcttagaaaccactcacaatttcagggctacgtagggcagcgaggtggacgatctcaggtgagctactacccagctgaaaattcttactcaaggtggagtggacttctaagcccctgtgatgctgattggcttgggatgcttgtcgtgaagaaggccaaggggtctgatatgatagttccagggccttcatacaaggggaaagtcttttttgaacggccaacttttgatggatacgtaggctggggctgtggtagtgggaagtctaggactgagtcaggtgagctctgcagttcagactccgggactagttctggtcttctgccctcagatagggttctctggataggtgatgttgcttgtcagcctatgacacccatccctgaggagacatttctggagctgaagagctttagccaaagtgaattcccagacatatgcaaaattgatggcattgtgttcaaccagtgtgagggtgagagtctacctcagccctttgatgttgcatggatgggtgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgcagatgctcacttgtgcacaagcccggggaagtcgttgtgtcatatggagggatgcgtgtcagaccaaagtgctatggtttctccagaatgatggcaacactggaggtgaacgaaccagagcagaggattggtcaatgcactggctgccatctagaatgcataaatgggggtgtgaggctaatcactctaaccagtgagctcaagtcagctactgtctgcgcttctcacttctgtagttctgccacaagtggtaagaaaagcacggagattcaattccactcaggatcattggttgggaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctactcaccaatgttcttaaggcaattggggtttgggggtcatgggtcatagctccagtgaagctagtgtttgccatcataaagaaactaatgagagctgtgagctgcctgatggggaaattgatggatagaggaaggcaagtgatccatgaggaaataggggagaatagagagggcaaccaagatgatgttaggattgagatggccagacccaggagggtaaggcattggatgtactcgcctgtcatcctgactattctagcaatggggcttgctgagggctgtgatgagatggtccatgctgattctaaacttgtttcgtgcaggcaagggagcggaaatatgaaggaatgtgtcacaactgggagggcgcttcttcctgcagtgaacccagggcaagaggcgtgtctgcacttcacggcacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgtggttgctttaatgcggccccttcttgcattttctggaggaaatgggtagagaatccacatgggatcatctggaaagtatctccatgtgccgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggtatagagctacgggtggatgacgctgtgtgctactctaagatcactagtgtggaggcagttgcaaactactctgccatacccaccactattggggggctgaggtttgagagaagccatgacagccagggcaaaatatctggtagccccctggacatcacagctataagaggatctttttctatcaattatagaggccttcgactgagcctcacagaaattactgcaacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagcactgtgcccacaggggcaaatatcccaagccctacagattggctaaatgccttgtttggcaatgggctgagtaggtggatcctgggggtgataggggtcctactggggggattggctctctttttcttgatcatgtctttgttcaagctgggaacaaaacaggtatttcgatcgaggacgaagctggcttaa

SEQ ID NO: 4890 - RNA, 3222 nt, synthetic construct
  misc_feature 1..3222: note = derived and/or modified CDS sequence (wt) from SFTSV/Phlebovirus(HN6/China/2010 strain HN6)__HQ141596.1__GP
  source 1..3222: mol_type = other RNA
atgatgaaagtcatctggttctcctctctgatctgctttgtcattcaatgcagtggggactcaggcccaatcatctgcgcaggacccatccactcaaacaagagtgctgacatacctcacctgctgggttactctgagaagatatgtcagatagatcggctgatacatgtttcgtcatggctcaggaaccactcacaatttcagggctacgtaggccagcgaggtggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtattcaaccagtgtgagggtgagagcctacctcagccctttgatgttgcatggatggatgttggccactctcataaaatcatcatgagggagcacaagaccaaatgggtgcaggagagctcatccaaggattttgtgtgctacaaggaagggactgggccttgttctgaatcagaagaaaagacttgtaagaccagtggatcatgcaggggggacatgcagttctgcaaggtagcaggttgtgaacatggggaagaggcatctgaagccaagtgcagatgctcacttgtgcacaagcccggagaagtcgttgtgtcatatggagggatgcgtgtcagaccaaagtgctatggtttctccagaatgatggcaacactggaggtgaaccaaccagagcaaaggattggtcaatgcactggctgccatctggaatgcataaatgggggtgtgaggctaataactctaaccagtgagctcaagtcagctactgtctgtgcctctcacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttgggtatgcaggcctcatgctactcaccaatgtcctcaaggcaattgggatttggggatcatgggtcatagctccagtgaagctaatatttgccatcataaagaaactaatgagaactgtgagctgcttggtggggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgcccccctcatttcacatccaactccttttctgatgattgggcaggtaagatggacagggctggtctagggttcagtggctgctctgatggatgtggaggagctgcctgcggctgctttaatgcagccccttcttgcatcttctggaggaaatgggtagagaacccacatgggatcatctggaaagtatctccttgtgccgcatgggtcccatcggcagtcatagagctaacaatgccctcaggggagatgaggacattccaccccatgagtggcatccccacacaagtcttcaagggtgtgagtgtgacttacttgggctcagatatggaggtgtctggcttgactgacttatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccacagtctctatcaaactacatagcagcaaaaatagcactgcccatgtaagatgcaaaggggatgagactgcattcagtgtcttggagggggtccatagctacactgtcagtctcagttttgaccatgcagtggtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctacttggggggttggctctctttttcatgattatgtctttgttcaagctgggaacaaaacaggtatttcgatcaaggacgaagctggcttag

SEQ ID NO: 4891 - RNA, 3222 nt, synthetic construct
  misc_feature 1..3222: note = derived and/or modified CDS sequence (wt) from SFTSV/Phlebovirus(JN1/China/2010)__JN258706.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccaaacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcaaaggattggtcaatgcactggctgccatctagaatgcataaatgggggtgtgaggctagtcactctaaccagtgagctcaggtcagctactgtctgtgcttcccacttttgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggagggcacttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgctcggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctagcattagctccctgcaaccaggctggcatgggggttgtaggcaaggttggagagatacagtgcagtagcgaggagagtgcccgtaccataaaaaaagatgggtgcatatggaatgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttgaagggagtccatagctacattgtcagcctcagctttgaccatgcagtagtcgatgagcaatgccagctgaactgtgggggacatgagagtcaagtgactcttaaaggcaacctcatcttcctggatgtcccaatatttgtggatggcagctacatgcagacatatcacagtactgtgccaacaggggcaaatatcccaagccctacagattggctgaatgccttgtttggcaatgggctgagtaggtggatcctgggggtgataggggttctactgggtggattggctctctttttcttgatcatgtttttgctcaagctgggaacaaaacaggtatttcgatcgaggacgaagctggcttag

SEQ ID NO: 4892 - RNA, 3222 nt, synthetic construct
  misc_feature 1..3222: note = derived and/or modified CDS sequence (wt) from SFTSV/Phlebovirus(JS2010-014)__JQ317170.1__GP
  source 1..3222: mol_type = other RNA
atgatgaaagtcatctggttctcctatctgatctgctttgtcattcaatgcagtggggactcgggcccaatcatctgggcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagctttagccaaagtgaattcccagacatatgcaaaattgatggcattgtgttcaaccagtgtgagggtgagagtctacctcagccttttgatgttgcatggatggatgttggccactctcataaaattatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgtacacaagcccggagaagtcgttgtgtcatatggagggatgcgtatcagaccaaagtgctatggtttctccagaatgatggcaacactggaggtgagccaaccagagcaaaggcttggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttgggggtcatgggtcatagctccagtgaagctaatgtttgccatcataaagaaactaatgagaactgtgagctgcttgatgaggaaattgatggatagggggaggcaagtgatccatgaggagataggggagaatagagtgggcaaccaagatgatgttaggattgagatggcaagacccagaagggtaaggcattggatgtactcacctgtcatcctaactattttagcaatagggcttgctgagagctgcgatgagatggtccatgctgattctaagcttgtttcatgcaggcaagggagcggaaacatgaaggaatgtgtcacaactgggagggcgcttcttcctgcggtgaacccaggtcaagaggcatgtctgcacttcacggcacctgggagtccggactcaaaatgcctcaaaattaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcggccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgctactctaagatcactagtgtggaagcagttgcaaactactctgccatacccaccactattggggggctgaggtttgagagaagccatgacagccagggtaaaatatctggtagccccctagacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtggggggcatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagcaggtggatcctgggggtgataggggttctgcttggggggttggctctcttttttatgattatgtctttgttcaagctgggaacaaaacaggtatttcgatcaaggacaaagctggcttag

SEQ ID NO: 4893 - RNA, 3222 nt, synthetic construct
  misc_feature 1..3222: note = derived and/or modified CDS sequence (wt) from SFTSV/Phlebovirus(JS2010-015)__JQ317173.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattcttactcaaggtggagtgggcttctaagcccctgtgatgctgattggcttgggatgcttgttgtgaagaaggccaaggggtctgacatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgtttaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggttgcaggttgtgaacatggggaagaggcatctgaagccaagtgtagatgctcacttgtacacaagcccggagaagtcgttgtgtcatatggagggatgcgtgtcagaccaaagtgctatggtttctccagaatgatggcaacactggaggtgaaccaaccagagcaaaggattggccaatgcactggctgccatctagaatgcataaatgggggtgtgaggctaataaccctaaccagtgagctcaagtcagctactgtctgtgcttcccacttttgtagttctgccacgagtggcaagaaaagcacggagattcaattccactcaggatcattggttgggaaaacagcaatccacgtcaaaggggcattggtagatggaactgaattcacatttgagggtagttgcatgttcccagatggttgtaatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactgtgagctgcttgatggggaaattgatggataggggaagacaagtgatccatgaggagataggggagaatagagagggcaaccaagatgatgttaggattgagatggcaagacccagaagggtaaggcattggatgtactcacctgtcatcctaacttttttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcgcctgggagtccggactcaaaatgtctcaaaattaaggttaagaggatcaacctaaaatgtaagaagtcatcatcatattttgttcctgatgcccggtccaggtgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggtagctacatgcagacatatcatagcactgtgcccacaggggcaaatatcccaagcccaacagactggctgaatgccttgtttggcaatgggctgagcaggtggatcctgggggtgataggggttctgcttggggggttggctctctttttcatgattatgtctttgttcaagctgggaacaaaacaggtatttcgatcaaggacaaagctggcttag

SEQ ID NO: 4894 - RNA, 3222 nt, synthetic construct
  misc_feature 1..3222: note = derived and/or modified CDS sequence (wt) from SFTSV/Phlebovirus(JS2010-019)__JQ317179.1__GP
  source 1..3222: mol_type = other RNA
atgatgaaagtcatctggttctcctctctgacctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggttagctactacccagctgaaaattcttactcaaggtggagtgggcttctaagcccctgtgatgctgattggcttgggatgcttgttgtgaagaaggccaaggggtctgatatgatagttcctgggccttcatacaaggggaaagtcttttttgagcggccaacttttgatggatatgtaggctggggctgtggtagtgggaagtctaggacagagtcaggggagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgttcaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggtagcaggttgtgaacatggagaagaggcatctgaagccaagtgtagatgctcacttgtacacaagcccggagaagtcgttgtgtcatatggagggatgcgtgtcagaccaaagtgctatggtttctccagaatgatggcaacactggaggtgaaccaaccagagcaaaggcttggtcaatgcactggctgccatctggaatgcataaatgggggtgtgaggctaataactctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtgatgcggtggactgcactttctgtcgtgagtttctaaaaaatccccagtgctaccctgcaaagaagtggctattcatcattattgtaatcctccttggatatgcaggcctcatgctactcaccaatgtcctcaaggcaattgggatttggggatcatgggtcatagctccagtgaagctaatgtttgccatcataaagaaactaatgagaactgtgagctgcttgatgaggaaattgatggataggggaaggcaagtgatccatgaggagataggggagaatagagagggcaaccaagatgatgttaggattgagatggcaagacccagaagggtaaggcattggatgtactcacctgtcatcctgactattttagcaatagggcttgctgagagctgcgatgagatggtccatgctgattctaagcttgtttcatgcaggcaagggagcggaaatatgaaggaatgtgtcacaactgggagggcgcttctttctgcggtgaacccaggtcaagaggcatgtctgcacttcacggcacctgggagtccggactcaaaatgtctcaaaattaaggttaagaggatcaacctaaaatgtaagaagtcatcatcatattttgttcctgatgcccggtccagatgtacatcagtgaggagatgtcgttgggctggagactgccagtctgggtgccccccccatttcacatccaactccttttctgatgattgggcaggtaagatggacagggctggtctagggtttagtggctgctctgatggatgtggaggagcagcctgcggctgctttaatgcagccccttcatgcatcttctggaggaaatgggtagagaacccacatggaatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaaactggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgttactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagactgcattcagtgtcttggagggaggtcatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagcaggtggatcctgggggtgataggggttctgcttggggggttggctctctttttcatgattatgtctttgttcaagctgggaacaaaacaggtatttcgatcaaggacaaagctggcttag

SEQ ID NO: 4895 - RNA, 3222 nt, synthetic construct
  misc_feature 1..3222: note = derived and/or modified CDS sequence (wt) from SFTSV/Phlebovirus(JS24)__HQ830164.1__GP
  source 1..3222: mol_type = other RNA
atgatgaaagtcatctggttctcctctctgatctgcttagtcattcaatgtggtggggatacaggcccaatcatctgcgcaggacccatccactcaaacaagagtgctgacatacctcacctgcttggctactctgagaagatttgtcagatagatcggctgatacatgtttcgtcatggcttagaaaccactcacaatttcagggctacgtagggcagcgaggtggacgctctcaggtgagctactacccagctgaaaattcttactcaaggtggagtggacttctaagcccctgtgatgctgattggcttgggatgcttgtcgtgaagaaggccaaggggtctgatatgatagttcctgggccttcatacaaggggaaagtcttctttgaacggccaacttttgatggatacgttggctggggctgtggtagtgggaagtctaggactgagtcaggtgagctctgcagttcagactctgggactagttctggtcttctgccctcggatagggttctctggataggtgatgttgcttgtcagcctatgacacccatccctgaggagacatttctggagctgaagagctttagccaaagtgaattcccagacatatgcaagattgatggcattgtgttcaaccagtgtgggggtgagagtctacctcagccctttgatgttgcatggatggatgttggccactctcacaaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagcccggggaagtcgttgtgtcatatggagggatgcgtgtcagaccaaagtgctatggtttctccagaatgatggcaacactggaggtgaaccaaccagagcaaaggattggtcaatgcactggctgccatctagaatgcataaatgggggtgtgaggctaatcactctaaccagtgagctcaagtcagctactgtctgcgcttctcacttttgtagttctgccacaagtggtaagaaaagcacggagattcaattccactcaggatcattggttggaaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctactcaccaatgttcttaaggcaattggggtttgggggtcatgggtcatagctccagtgaagctagtgtttgccatcataaagaaactaatgagagctgtgagctgcctgatggggaaattgatggataggggaaggcaagtgatccatgaggaaataggggagaatagagagggcaaccaagatgatgttaggattgagatggccagacccaggagggtaaggcattggatgtactcgcctgtcatcctgactattctagcaatagggcttgctgagggctgtgatgagatggtccatgctgattctaaacttgtttcgtgcaggcaaggaagcggaaatatgaaggaatgtgtcacaactgggagggcgcttcttcctgcggtgaacccagggcaagaggcgtgtctgcacttcacggcacctggaagtccagactcaaaatgtctcaaaattaaggttaagaagatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagcggctgctctgatggatgtggaggagcagcctgcggttgctttaatgcggccccttcatgcattttctggaggaaatgggtagagaatccacatgggatcatctggaaagtctctccatgtgccgcatgggtcccatcagcagttatagagctaacaatgccctcaggggaggtgaggacattccaccccatgagcggaatccccacacaagtcttcaagggtgtgagtgtaacttacttgggctcagatatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggcatagagctacgagtggatgacgctgtgtgttactctaagatcactagtgtggaggcagttgcaaactactctgctatacccaccactattggggggctgaggtttgagagaagccatgacagccagggtaaaatatctggtagccccctggacatcacagctataagaggatctttttctgtcaattatagaggccttcgactgagtctctcagaaattactgctacgtgtacaggggaagtgacaaatgtgagtgggtgttattcatgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtggggggcatgagagtcatgtaactctgaaaggtaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggtgtgataggggtcctactggggggattggctctctttttcttgatcatgtctttgttcaagctgggaacaaaacaggtatttcgatcgaggacgaagctggcttag

SEQ ID NO: 4896 - RNA, 3222 nt, synthetic construct
  misc_feature 1..3222: note = derived and/or modified CDS sequence (wt) from SFTSV/Phlebovirus(JS4/China/2010 strain JS4)__HQ141605.1__GP
  source 1..3222: mol_type = other RNA
atgatgaaagtcatctggttctcctctctgatctgctttgtcattcaatgcagtggggactcgggcccaatcatctgcgcaggacccattcactcaaacaagagtgctgacataccccacctgcttggttactctgagaagatttgtcagatagatcggctgatacatgtttcgtcatggctcagaaaccactcacaatttcagggctacgtagggcagcgaggtggacgctctcaggtgagctactacccagctgaaaattcttactcaaggtggagtggacttctaagcccctgtgatgctgattggcttgggatgcttgtcgtgaagaaggccaaggggtctgatatgatagttcctggaccttcatacaaggggaaagtcttttttgaacggccaacttttgatggatatgtaggctggggctgtggcagtgggaagtctaggactgagtcaggagagctctgcagttcagactcagggactagttctggtcttctaccctcggatagggttctctggataggtgatgttgcttgtcaacctatgacacctatccctgaggagacattcctggagctgaagagctttagccaaagtgaattcccagacatatgtaaaattgatggcattgtgttcaaccagtgtgaaggtgagagtctacctcagccctttgatgttgcatggatggatgttggccactctcacaaaatcatcatgagggagcacaagaccaaatgggtacaagagagctcatccaaggattttgtgtgctacaaggaagggactgggccttgttcagaatcagaagaaaagacttgcaagaccagtgggtcatgcaggggggacatgcagttttgcaaggtggctggatgtgaacatggggaagaggcatctgaagccaagtgtagatgctcacttgtgcacaagcccggggaagtcgttgtgtcttatggagggatgcgtgtcagaccaaagtgctatggattctctagaatgatggcaacactggaggtaaacccaccagagcaaaggattggtcaatgcactggctgccatctagaatgcataaacgggggtgtgaggctaatcactctaaccagtgagctcaagtcagctactgtctgtgcttcccacttttgtagttctgccacaagtggtaagaaaagcacggaaattcaattccactcaggatcattggtcgggaaaacagcgatacacgtcaaaggggcattggtagatgggactgaattcacatttgagggtagttgcatgttcccagatggttgcgatgcagtggactgcacattctgtcgtgagtttctaaaaaatccacagtgctaccctgcaaagaagtggctgtttatcattattgtcatcctccttggatatgcaggcctcatgctactcaccaatgtcctcaaggcaattggggtttgggggtcatgggtcatagctccagtgaagctactgtttgccatcataaagaaactaatgagaactgtaagctgcttgatggggaaattgatggataggggaaggcaagtgatccatgaggaaataggggagaatagagagggcaaccaagatgatgttaggatcgagatggcaagacccagaagggtaaggcattggatgtactcacctgtcatcctgactattctagcaatagggcttgctgagggctgtgatgagatggtccatgctgattctaaacttgtttcatgcaggcaagggagcgaaaatatgaaggaatgtgtcacaactgggagggcgcttcttcctgcagtgaacccaggtcaagaggcatgtctgcacttcacggcacctgggagtccggactcaaaatgtctcaaaattaaggtaaagaggatcaacctaaaatgtaagaagtcatcatcatattttgttcctgatgcccggtctaggtgtacatcagtgaggagatgtcgttgggcaggagactgccagtctgggtgtccccctcatttcacatccaactccttttctgatgattgggcaggcaagatggacagggctggtctaggattcagtggctgctctgatggatgtggaggagcagcctgcggctgctttaatgcggccccttcatgcatcttctggaggaaatgggtagagaatccacatgggatcatctggaaagtatctccatgtgccgcatgggtcccatcggcagttatagagctaacaatgccctcaggggaggtgaggacattccaccccatgagtggcatccccacacaagtcttcaagggtgtgagtgtaacttacttgggttcagatatggaggtgtctggcttgacagatctttgtgagatagaagagctcaagtccaagaagctggcattagctccctgcaaccaggctggcatgggggttgtaggcaaggttggagagatacagtgcagtagtgaggaaagtgcccgtaccataaaaaaagatgggtgcatatggaatgcagaccttgtgggcatagagctacgagtggatgacgctgtgtgctactctaagatcactagtgtggaggcagttgcaaactactctgccatacccaccactattggggggctgaggtttgagagaagccatgacagccagggtaaaatatctggtagccccctagacatcacagctataagaggatctttttctgttaattatagaggccttcgtctgagtctctcagaaattactgctacttgcacaggggaggttacaaatgtgagtgggtgttattcttgcatgacaggcgccaaagtctccatcaaattacatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagccaagtgactctaaaaggtaacctcatcttcctggatgtcccaaaatttgtggatggcagctacatgcagacatatcacagtactgtgcccacaggggcaaatatcccaagccctacagattggctgaatgccttgtttggcaatgggctgagtaggtggattctgggggtgataggggttctacttgggggattggctctctttttcttgattatgtctttgttcaagctgggaacaaaacaggtatttcgatcaaggacgaagctggcttag

SEQ ID NO: 4897 - RNA, 3222 nt, synthetic construct
  misc_feature 1..3222: note = derived and/or modified CDS sequence (wt) from SFTSV/Phlebovirus(JS6)__HQ830170.1__GP
  source 1..3222: mol_type = other RNA
atgatgaaagtcatctggttctcctctctgatctgcttagtcattcaatgcggtggggatacaggcccaatcatctgcgcaggacccatccactcaaacaagagtgctgacataccccacctgcttggctactctgagaagatttgtcagatagatcggctgatacatgtttcgtcatggcttagaaaccactcacaatttcagggctacgtagggcagcgaggtggacgatctcaggtgagctactacccagctgaaaattcttactcaaggtggagtggacttctaagcccctgtgatgctgattggcttgggatgcttgttgtgaagaaggccaaggggtctgatatgatagttccagggccttcatacaaggggaaagtcttttttgaacggccaacttttgatggatacgtaggctggggctgtggtagtgggaagtctaggactgagtcaggtgagctctgcagttcagactccgggactagttctggtcttctgccctcagatagggttctctggataggtgatgttgcttgtcagcctatgacacccatccctgaggagacatttctggagctgaagagctttagccaaagtgaattcccagacatatgcaaaattgatggcattgtgttcaaccagtgtgagggtgagagtctacctcagccctttgatgttgcatggatggatgttggccactctcataaaatcatcatgagggagcacaagaccaaatgggtacaagagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgcagatgctcacttgtgcacaagcccggggaagtcgttgtgtcatatggagggatgcgtgtcagaccaaagtgctatggtttctccagaatgatggcaacactggaggtgaacgaaccagagcagaggattggtcaatgcactggctgccaactagaatgcataaatgggggtgtgaggctaatcactctaaccagtgagctcaagtcagctactgtctgcgcttctcacttctgtagttctgccacaagtggtaagaaaagcacggagattcaattccactcaggatcattggttgggaaaacagcaatccacgtcaaaggggcattggtagatggaactgaattcacatttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctactcaccaatgttcttaaggcaattggggtttgggggtcatgggtcatagctccagtgaagctagtgtttgccatcataaagaaactaatgagagctgtgagctgcctgatggggaaattgatggatagaggaaggcaagtgatccatgaggaaataggggagaatagagagggcaaccaagatgatgttaggattgagatggccagacccaggagggtaaggcattggatgtactcgcctgtcatcctgactattctagcaatggggcttgctgagggctgtgatgagatggtccatgctgattctaaacttgtttcgtgcaggcaagggagcggaaatatgaaggaatgtgtcacaactgggagggcgcttcttcctgcagtgaacccagggcaagaggcgtgtctgcacttcacggcacctggaagtccggactcaaaatgtctcaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgtggttgctttaatgcggccccttcttgcattttctggaggaaatgggtagagaatccacatgggatcatctggaaagtatctccatgtgctgcatgggtcccatcagcggttatagagctaacaatgccctcaggggaggtgaggacattccaccccatgagcggaatccccacacaagtcttcaagggtgtgagtgtaacttacttgggctcagatatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggtatagagctacgggtggatgacgctgtgtgctactctaagatcactagtgtggaggcagttgcaaactactccgccatacccaccactattggggggctgaggtttgagagaagccatgacagccagggcaaaatatctggtagccccctggacatcacagctataagaggatctttttctatcaattatagaggccttcgactgagcctctcagaaattactgctacttgcacaggggaagtgacaaatgtgagtgggtgttattcttgcatgacaggcgccaaagtctccatcaagttgcatagcagcaaaaatagcactgcccatgtaagatgcaaaggggatgagactgccttcagtgtcttggagggagtccatagctactctgtcagtctcagttttgatcatgcagtagttgatgagcagtgccaactgaactgtgggggacatgagagtcaagtgactctgagaggcaacctcatcttcctggatgtcccgaaatttgtggatggcagctacatgcagacatatcatagcactgtgcccacaggggcaaatatcccaagccctacagattggctaaatgccttgtttggcaatgggctgagtaggtggatcctgggggtgataggggtcctactggggggattggctctctttttcttgatcatgtctttgttcaagctgggaacaaaacaggtatttcgatcgaggacgaagctggcttaa

SEQ ID NO: 4898 - RNA, 3222 nt, synthetic construct
  misc_feature 1..3222: note = derived and/or modified CDS sequence (wt) from SFTSV/Phlebovirus(JSD1)__JF267784.1__GP
  source 1..3222: mol_type = other RNA
atgatgaaagtcatctggttctcctctctgatctgctttgtcattcaatgcagtggggactcgggcccaatcatctgtgcaggacccatccactcaaacaagagtgctgacatacctcacctgctgggttactctgagaagatatgtcagatagatcgactgatacatgtttcgtcatggctcagaaaccactcacaatttcagggttacgtagggcagcgaggtggacgctctcaggtgagctactacccagctgaaaattctcactcaaggtggagtgggcttctaagcccctgtgatgctgattggcttgggatgcttgttgtgaagaaggccaaggggtctgacatgatagttcctgggccttcatacaaggggaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaagagacatttctggagctgaagagttttagccaaagtgaattcccagacatatgcaaaattgatggcattgtgtttaaccagtgtgagggtgagagtctacctcagccttttgatgttgcatggatggatgttggccactctcataaaatcatcatgagggagcacaagaccaaatgggtgcaagagagctcatccaaggattttgtgtgctataaggaagggactgggccttgttctgaatcagaagaaaagacttgcaagaccagtggatcatgcaggggggacatgcagttctgcaaggttgcaggttgtgaacatggggaagaggcatctgaagccaagtgtagatgctcacttgtacacaagcccggagaagtcgttgtgtcatatggagggatgcgtgtcagaccaaagtgctatggtttctccagaatgatggcaacactggaggtgaaccaaccagagcaaaggattggccaatgcactggctgccatctagaatgcataaatgggggtgtgaggctaataaccctaaccagtgagctcaagtcagctactgtctgtgcttcccacttttgtagttctgccacgagtggcaagaaaagcacggagattcaattccactcaggatcattggttgggaaaacagcaatacacgtcaaaggggcattggtagatggaactgaattcacatttgagggtagttgcatgttcccagatggttgtaatgcggtggactgcactttctgtcgtgagtttctaaaaaatccccagtgctaccctgcaaagaagtggctgttcatcattattgtcatcctccttggatatgcaggcctcatgctactcaccaatgtcctcaaggcaattgggatttggggatcatgggtcatagctccagtgaagctaatgtttgccatcataaagaaactaatgagaactgtgagctgcttgatggggaaattgatggataggggaagacaagtgatccatgaggagataggggagaatagagagggcaaccaagatgatgttaggattgagatggcaagacccagaagggtaaggcattggatgtactcacctgtcatcctaacttttttagcaatagggcttgctgagagctgcgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcgcctgggagtccggactcaaaatgtctcaaaattaaggttaagaggatcaacctaaaatgtaagaagtcatcatcatattttgttcctgatgcccggtccaggtgtacatcagtgaggagatgtcgttgggctggagactgccagtctgggtgccccccccatttcacatccaactccttttctgatgattgggcaggtaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccccacacaagtcttcaagggtgtgagtgtgacttacttaggctcagatatggaggtgtctggcttgacagacctatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtagatgacgctgtgtgctactctaagatcactagtgtggaagcagttgcaaactactctgccatacccaccactattggggggctgaggtttgagagaagccatgacagccagggtaaaatatctggtagccccctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaaactgcacagcagcaaaaatagcactgcccatgtaagatgcaaaggggatgagacagcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggtagctacatgcagacatatcatagcactgtgcccacaggggcaaatatcccaagcccaacagactggctgaatgccttgtttggcaatgggctgagcaggtggatcctgggggtgataggggttctgcttggggggttggctctctttttcatgattatgtctttgttcaagctgggaacaaaacaggtatttcgatcaaggacaaagctggcttag

SEQ ID NO: 4899 - RNA, 3222 nt, synthetic construct
  misc_feature 1..3222: note = derived and/or modified CDS sequence (wt) from SFTSV/Phlebovirus(LN2/China/2010 strain LN2)__HQ141608.1__GP
  source 1..3222: mol_type = other RNA
atgatgaaagtcatctggttctcctctctgatctgctttgtcattcaatgcagtggggactcgggcccaatcatctgcgcaggacccatccattcaaacaagagtgctgacatacctcacctgctgggttactctgagaagatatgtcagatagatcggctgatacatgtttcgtcatggctcagaaaccactcacaatttcagggctacgtagggcagcgaggaggacgctctcaggtgagctactacccagctgaaaattcttactcaaggtggagtgggcttctaagcccctgtgatgctgattggcttgggatgcttgtcgtgaagaaggccaaggggtctgatatgatagttcctgggccttcatacaagggaaaagtcttttttgagcggccaacttttgatggatatgtaggctggggctgtggcagtgggaagtctaggacagagtcaggagagctctgcagttcagactcagggactagctctggtcttctgccctcagatagggttctctggataggtgatgttgcttgtcagcctatgacacccatccctgaggagacatttctggagctgaagagttttagccaaagtgaattcccagacatatgcagaattgatggcattgtgttcaaccagtgtgagggtgagagtctacctcagccctttgatgttgcatggatggatgttggccactctcataaaatcatcatgagggagcacaagaccaaatgggtgcaagagagctcatccaaggattttgtgtgctacaaggaagggactgggccttgttctgaatcagaagaaaagacttgcaagaccagtggatcatgcaggggggacatgcagttctgcaaggtagcaggttgtgaacatggggaagaggcatctgaagccaagtgtagatgctcacttgttcacaagcccggagaagtcgttgtgtcatatggagggatgcgtgtcagaccaaagtgctatggtttctccagaatgatggcaacactggaggtgaaccaaccagtgcaaaggattggtcaatgcactggctgccatctggaatgcataaatgggggtgtgaggctaataactctaaccagtgagctcaagtcagctactgtctgtgcttcccacttttgtagttctgccacgagtggcaagaaaagcacggagatacaattccactcaggatcattggttgggaaaacagcaatacacgtcaaaggggcattggtagatggaactgaattcacatttgagggtagctgcatgttcccggatggttgtgatgcggtggactgcactttctgtcgtgagtttctaaaaaatcctcagtgctaccctgcaaagaagtggctgttcatcattattgtcatcctccttggatatgcaggcctcatgctactcaccaatgtcctcaaggcaattggaatttggggatcatgggtcatagctccagtgaagctaatatttgccatcataaagaaactaatgagaactgtgagctgcttgatggggaaattgatggataggggaaggcaagtgatccatgaggagataggggagaatagagagggcaaccaagatgatgttaggattgagatggcaagacccagaagggtaaggcattggatgtacgcacctgtcatcctgactattttagcaatggggcttgctgagagctgtgatgagatggtccatgctgattctaagcttgtttcatgcaggcaagggagcggaaatatgaaggaatgtgtcacaactgggagggcgcttcttcctgcggtgaacccaggtcaagaggcatgtctgcacttcacggcacctgggagtccggactcaaaatgtctcaaaattaaggttaagaggatcaacctaaaatgcaagaagtcatcatcatattttgttcctgatgcccggtccagatgtacatcagtgaggagatgtcgttgggctggagactgccagtcagggtgcccccctcatttcacatccaactctttttctgatgattgggcaggcaagatggacagggctggtctagggttcagtggctgctctgatggatgtggaggagcagcctgcggctgctttaatgcagccccttcatgcatcttctggaggaaatgggtagagaacccacatgggatcatctggaaagtatctccttgtgccgcatgggtcccatcggcagtcatagagctaacaatgccctcaggggaggtgaggacattccaccccatgagtggcatccctacacaagtcttcaagggtgtgagtgtgacttacttgggctcagatatggaggtgtctggcttgactgacttatgtgagatagaggagctcaagtccaagaagctggcattagctccctgcaaccaggctggcatgggggttgtaggcaaggttggagagatacagtgcagtagcgaggaaagtgcccgtaccataaaaaaagatgggtgcatatggaatgcagaccttgtgggcatagagctacgagtggatgatgctgtgtgctactctaagatcactagtgtagaagcagttgcaaactactctgccatacccaccactattggggggctgaggtttgagagaagccatgacagccagggtaaaatatctggtagccctctggacatcacagctataagaggatctttttctgttaattatagaggccttcgactgagcctctcagaaattactgctacctgcacaggggaggtgacaaatgtgagtggatgttattcttgcatgacaggcgccaaagtctctatcaagctgcatagtagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagtcaagtgactctaaaaggcaaccttatcttcctggatgtcccaaaatttgtggatggcagctacatgcagacatatcatagcactgtgcccacaggggcaaatatcccaagcccaacagactggctgaatgccttgtttggcaatgggctgagtaggtggatcctgggggtgataggggttctgcttgggggattggctctctttttcatgatcatgtctttgttcaagctgggaacaaaacaggtatttcgatcaaggacgaagctggcttag

SEQ ID NO: 4900 - RNA, 3222 nt, synthetic construct
  misc_feature 1..3222: note = derived and/or modified CDS sequence (wt) from SFTSV/Phlebovirus(LN3/China/2010 strain LN3)__HQ141611.1__GP
  source 1..3222: mol_type = other RNA
atgatgaaagtcatctggttctcctctctgatctgcttagtcattcaatgtggtggggatacgggcccaatcatctgcgcaggacccatccactcaaacaagagtgctgacataccccacctgcttggctactctgagaagatttgtcagatagatcggctgatacatgtttcgtcatggcttagaaaccactcacaatttcagggctacgtagggcagcgaggtggacgctctcaggtgagctactacccagctgaaaattcttactcaaggtggagtggacttctaagcccctgtgatgctgattggcttgggatgcttgtcgtgaagaaggccaaggggtctgatatgatagttcctgggccttcatacaaggggaaagtcttttttgaacggccaacttttgatggatacgtaggctggggctgtggtagtgggaagtctaggactgagtcaggtgagctctgcagttcagactctgggactagttctggtcttctgccctcggatagggttctctggataggtgatgttgcttgtcagcctatgacacccatccctgaggagacatttctggagctgaagagctttagccaaagtgaattcccagacatatgcaaaattgatggcattgtgttcaaccagtgtgagggtgagagtctacctcagccctttgatgttgcatggatggatgttggccactctcataaaatcatcatgagagagcacaagaccaaatgggtacaggagagctcatccaaggattttgtgtgctacaaggaagggactgggccttgttctgaatcagaagaaaagacttgcaagaccagtggatcatgcaggggggacatgcagttttgcaaggtggcaggttgtgaacatggggaagaggcatctgaagccaagtgtagatgctcacttgtgcacaagcccggggaagtcgttgtgtcatatggagggatgcgtgtcagaccaaagtgctatggtttctccagaatgatggcaacactggaggtgaaccaaccagagcaaaggattggtcaatgcactggctgccatctagaatgcataaatgggggtgtgaggctaatcactctaaccagtgagctcaagtcagctactgtctgcgcttctcacttttgtagttctgccacaagtggtaagaaaagcacggagattcagttccactcaggatcattggttgggaaaacagcaatccacgtcaaaggggcattggtagatggaactgaattcacttttgagggtagttgcatgttcccagatggttgtgatgcagtggactgcacattctgtcgtgagtttctaaaaaatccccagtgctaccctgcaaagaagtggctgttcatcattattgtcatcctccttggatatgcaggcctcatgctactcaccaatgttcttaaggcaattggggtttgggggtcatgggtcatagctccagtgaagctagtgtttgccatcataaagaaactaatgagagctgtgagctgcctgatggggaaattgatggatagggggaggcaagtgatccatgaggaaataggggagaatagagagggcaaccaagatgatgttaggattgagatggccagacccaggagggtaaggcattggatgtactcgcctgtcatcctgactattctagcaatagggcttgctgagggctgtgatgagatggtccatgctgattctagacttgtttcgtgcaggcaaggaagcggaaatatgaaggaatgtgtcacaactgggagggcgcttcttcctgcggtgaacccagggcaagaggcgtgtctgcacttcacggcacctggaagtccggactcaaaatgtcttaaaattaaggttaagaggatcaacctaaaatgtaaaaagtcatcatcatattttgttcctgatgcccggtccaggtgtacatcagtgaggagatgtcgttgggcaggggactgccagtctgggtgcccccctcatttcacatccaactccttttctgatgattgggcaggtaagatggacagggctggtctaggattcagtggctgctctgatggatgtggaggagcagcctgcggttgctttaatgcggccccttcatgcattttctggaggaaatgggtagagaatccacatgggattatctggaaagtatctccatgtgccgcatgggtcccatcagcagttatagagctaacaatgccctcaggggaggtgaggacattccaccccatgagcggaatccccacacaagtcttcaagggtgtgagtgtaacttacttgggctcagatatggaggtgtcaggcttgactgacctgtgtgagatagaagagctcaagtcaaagaagcttgcattagctccctgcaaccaggctggtatgggggttgtaggcaaggttggagagatacagtgcagtagcgaggaaagtgcccgtaccataaaaaaagatgggtgcatatggaatgctgacctcgtgggtatagagctacgagtggatgacgctgtgtgctactctaagatcactagtgtggaggcagttgcaaactactctgccatacccaccactattggggggctgaggtttgagagaagccatgacagccagggcaaaatatctggtagccccctggacatcacagctataagaggatctttttctgtcaattatagaggccttcgactgagtctctcagaaattactgctacgtgtacaggggaagtaacaaatgtgagtgggtgttattcatgcatgacaggcgccaaagtctccatcaagttgcatagcagcaaaaatagcactgcccatgtaagatgcaaaggggacgagactgccttcagtgtcttggagggagtccatagctactctgtcagtctcagttttgatcatgcagtagttgatgagcagtgccaactgaactgtggggggcatgagagtcatgtgactctgagaggtaacctcatcttcctggatgtcccgaaatttgtggatggcagctacatgcagacatatcatagtactgtgcccacaggggcaaatatcccaagccctacagattggctaaatgccttgtttggcaatgggctgagtaggtggattctgggggtgataggggtcctactggggggattggctctctttttcttgatcatgtctttgttcaagctgggaacaaaacaggtatttcgatcgaggacgaagctggcttag

SEQ ID NO: 4901 - RNA, 3222 nt, synthetic construct
  misc_feature 1..3222: note = derived and/or modified CDS sequence (wt) from SFTSV/Phlebovirus(SD24/China/2010 strain SD24)__HM802201.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagaactctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatattgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagacgggtaaggcattggatgtactcacctgtcatcctgaccattctagcaatagggcttgctgagggctgtgatgaaatggtccatgctgattctaaacttgtttcatgcagacaagggagcggaaatatgaaggaatgcatcacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgctcggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaatgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 4902 - RNA, 3222 nt, synthetic construct
  misc_feature 1..3222: note = derived and/or modified CDS sequence (wt) from SFTSV/Phlebovirus(SD4/China/2010 strain SD4)__HM802203.1__GP
  source 1..3222: mol_type = other RNA
atgatgaaagtcatctggttctcctctctgatctgctttgtcattcaatgcagtggggactcgggcccaatcatctgcgcaggacccattcactcaaacaagagtgctgacataccccacctgcttggttactctgagaagatttgtcagatagatcggctgatacatgtttcgtcatggctcagaaaccactcacaatttcagggctacgtagggcagcgaggtggacgctctcaggtgagctactacccagctgaaaattcttactcaaggtggagtggacttctaagcccctgtgatgctgattggcttgggatgcttgtcgtgaagaaggccaaggggtctgatatgatagttcctggaccttcatacaaggggaaagtcttttttgaacggccaacttttgatggatatgtaggctggggctgtggcagtgggaagtctaggactgagtcaggagagctctgcagttcagactcagggactagttctggtcttctaccctcggatagggttctctggataggtgatgttgcttgtcaacctatgacacctatccctgaggagacattcctggagctgaagagctttagccaaagtgaattcccagacatatgtaaaattgatggcattgtgttcaaccagtgtgaaggtgagagtctacctcagccctttgatgttgcatggatggatgttggccactctcacaaaatcatcatgagggagcacaagaccaaatgggtacaagagagctcatccaaggattttgtgtgctacaaggaagggactgggccttgttcagaatcagaagaaaagacttgcaagaccagtgggtcatgcaggggggacatgcagttttgcaaggtggctggatgtgaacatggggaagaggcatctgaagccaagtgtagatgctcacttgtgcacaagcccggggaagtcgttgtgtcttatggagggatgcgtgtcagaccaaagtgctatggattctctagaatgatggcaacactggaggtaaacccaccagagcaaaggattggtcaatgcactggctgccatctagaatgcataaacgggggtgtgaggctaatcactctaaccagtgagctcaagtcagctactgtctgtgcttcccacttttgtagttctgccacaagtggtaagaaaagcacggaaattcaattccactcaggatcattggtcgggaaaacagcgatacacgtcaaaggggcattggtagatgggactgaattcacatttgagggtagttgcatgttcccagatggttgcgatgcagtggactgcacattctgtcgtgagtttctgaaaaatccacagtgctaccctgcaaagaagtggctgtttatcattattgtcatcctccttggatatgcaggcctcatgctactcaccaatgtcctcaaggcaattggggtttgggggtcatgggtcatagctccagtgaagctactgtttgccatcataaagaaactaatgagaactgtaagctgcttgatggggaaattgatggataggggaaggcaagtgattcatgaggaaataggggagaatagagagggcaaccaagatgatgttaggatcgagatggcaagacccagaagggtaaggcattggatgtactcacctgtcatcctgactattctagcaacagggcttgctgagggctgtgatgagatggtccatgctgattctaaacttgtttcatgcaggcaagggagcggaaatatgaaggaatgtgtcacaactgggagggcgcttcttcctgcagtgaacccaggtcaagaggcatgtctgcacttcacggcacctgggagtccggactcaaaatgtctcaaaattaaggtaaagaggatcaacctaaaatgtaagaagtcatcatcatattttgttcctgatgcccggtctaggtgtacatcagtgaggagatgtcgttgggcaggagactgccagtctgggtgtccccctcatttcacatccaactccttttctgatgattgggcaggcaagatggacagggctggtctaggattcagtggctgctctgatggatgtggaggagcagcctgcggctgctttaatgcggccccttcatgcatcttctggaggaaatgggtagagaatccacatgggatcatctggaaagtatctccatgtgccacatgggtcccatcggcagttatagagctaacaatgccctctggggaggtgaggacattccaccccatgagtggcatccccacacaagtcttcaagggtgtgagtgtaacttatttgggttcagatatggaggtgtctggcttgacagatctttgtgagatagaagagctcaagtccaagaagctggcattagctccctgcaaccaggctggcatgggggttataggcaaggttggagagatacagtgcagtagtgaggaaagtgcccgtaccataaaaaaagatgggtgcatatggaatgcagaccttgtgggcatagagctacgagtggatgacgctgtgtgctactctaagatcactagtgtggaggcagttgcaaactactctgccatacccaccactattggggggctgaggtttgagagaagccatgacagccagggtaaaatatctggtagccccctagacatcacagctataagaggatctttttccgttaattatagaggccttcgtctgagtctctcagaaattactgctacttgcacaggggaggttacaaatgtgagtgggtgttattcttgcatgacaggcgccaaagtctccatcaaattacatagcagcaaaaatagcactgcccatgtaagatgcaaaggggatgagactgcattcagtgtcttggagggggtccatagctacactgtcagtctcagttttgaccatgcagtagtcgatgagcagtgccaactgaactgtgggggacatgagagccaagtgactctaaaaggtaacctcatcttcctggatgtcccaaaatttgtggatggcagctacatgcagacatatcacagtactgtgcccacaggggcaaatatcccaagccctacagattggctgaatgccttgtttggcaatgggctgagtaggtggattctgggggtgataggggttctacttgggggattggctctctttttcttgattatgtctttgttcaagctgggaacaaaacaggtatttcgatcaaggacgaagctggcttag

SEQ ID NO: 4903 - RNA, 3222 nt, synthetic construct
  misc_feature 1..3222: note = derived and/or modified CDS sequence (wt) from SFTSV/Phlebovirus(SDYY104/China/2011)__KU239112.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggccaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaatagttttagccaaagtgaattcccagacatatgtaaaattgatggcattgtgttcaaccagtgtgagggtgagagtttaccccagccctttgatgttgcatggatggatgttggccactcccataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggatgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgccacaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgctgagggctgtgatgagatggtccatgctgattctaaacttgtttcatgcagacaagggagcggaaatatgaaggaatgcatcacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctatgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaatgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgttattcctgcatgacaggcgccaaagtctccatcaaattgcatagcagcaaaaatagcactgcccatgttagatgcaaaggggatgagactgcattcagtgtcttggagggagtccatagctacattgtcagcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcgtgtttttgctcaagctgggaacaaaacaggcatttcgatcgaggacgaagctggcttag

SEQ ID NO: 4904 - RNA, 1287 nt, synthetic construct
  misc_feature 1..1287: note = derived and/or modified CDS sequence (opt4) from ANDV(Chile-9717869)__AF291702.1__N
  source 1..1287: mol_type = other RNA
atgagcaccctgcaggagctgcaggagaacatcaccgcccacgagcagcagctggtgaccgccagacagaagctgaaggacgccgagaaggccgtggaggtggaccccgacgacgtgaacaagagcaccctgcagagcagaagagccgccgtgagcaccctggagaccaagctgggcgagctgaagagacagctggccgacctggtggccgcccagaagctggccaccaagcccgtggaccccaccggcctggagcccgacgaccacctgaaggagaagagcagcctgagatacggcaacgtgctggacgtgaacagcatcgacctggaggagcccagcggccagaccgccgactggaaggccatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacgtgagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcggcttcttcgtgaaggactggatggacagaatcgaggagttcctggccgccgagtgccccttcctgcccaagcccaaggtggccagcgaggccttcatgagcaccaacaagatgtacttcctgaacagacagagacaggtgaacgagagcaaggtgcaggacatcatcgacctgatcgaccacgccgagaccgagagcgccaccctgttcaccgagatcgccaccccccacagcgtgtgggtgttcgcctgcgcccccgacagatgcccccccaccgccctgtacgtggccggcgtgcccgagctgggcgccttcttcagcatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagagcctgatcgacaccaaggtgaaggagatcagcaaccaggagcccctgaagctgtga

SEQ ID NO: 4905 - RNA, 1287 nt, synthetic construct
  misc_feature 1..1287: note = derived and/or modified CDS sequence (opt4) from ANDV(Nort)__AF325966.1__N
  source 1..1287: mol_type = other RNA
atgagcaccctgcaggagctgcaggagaacatcaccgcccacgagcagcagctggtgaccgccagacagaagctgaaggacgccgagaagaccgtggaggtggaccccgacgaggtgaacaagagcaccctgcagagcagaagagccgccgtgagcaccctggagaccaagctgggcgagctgaagagacagctggccgacctggtggccgcccagaagctggccaccaagcccgtggaccccaccggcctggagcccgacgaccacctgaaggagaagagcagcctgagatacggcaacgtgctggacgtgaacagcatcgacctggaggagcccagcggccagaccgccgactggaaggccatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacgtgagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcagcttcttcgtgaaggactggatggagagaatcgaggacttcctggccgccgagtgccccttcctgcccaagcccaaggccctgagcgaggccttcatggccaccaacaaggcctacttcctgaacagacagagacaggtgaacgacagcaaggtgcaggacatcgtggacctgatcgaccacgccgagatcgagagcgccaccctgttcaccgacatcgccaccccccacagcgtgtgggtgttcgcctgcgcccccgacagatgcccccccaccgccctgtacgtggccggcgtgcccgagctgggcgccttcttcgccatcctgcaggacatgagaaacaccatcatggccagcaagagcgtgggcaccgccgaggagaagctgaagaagaagagcgccttctaccagagctacctgagaagaacccagtacatgggcatccagctggaccagaagatcatcatcctgtacatgctgagctggggcaaggaggccgtgaaccacttccacctgggcgacgacatggaccccgagctgagacagctggcccagagcctgatcgacaccaaggtgaaggagatcagcaaccaggagcccctgaagctgtga

SEQ ID NO: 4906 - RNA, 1287 nt, synthetic construct
  misc_feature 1..1287: note = derived and/or modified CDS sequence (opt4) from ANDV(CHI-7913)__AY228237.1__N
  source 1..1287: mol_type = other RNA
atgagcaccctgcaggagctgcaggagaacatcaccgcccacgagcagcagctggtgaccgccagacagaagctgaaggacgccgagaaggccgtggaggtggaccccgacgacgtgaacaagagcaccctgcagaacagaagagccgccgtgagcaccctggagaccaagctgggcgagctgaagagacagctggccgacctggtggccgcccagaagctggccaccaagcccgtggaccccaccggcctggagcccgacgaccacctgaaggagaagagcagcctgagatacggcaacgtgctggacgtgaacagcatcgacctggaggagcccagcggccagaccgccgactggaaggccatcggcgcctacatcctgggcttcgccatccccatcatcctgaaggccctgtacatgctgagcaccagaggcagacaggccgtgaaggacaacaagggcaccagaatcagattcaaggacgacagcagcttcgaggaggtgaacggcatcagaaagcccaagcacctgtacgtgagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcggcttcttcgtgaaggactggatggacagaatcgaggagttcctggccgccgagtgccccttcctgcccaagcccaaggtggccagcgaggccttcatgagcaccaacaagatgtacttcctgaacagacagagacaggtgaacgagagcaaggtgcaggacatcatcgacctgatcgaccacgccgagaccgagagcgccaccctgttcaccgagatcgccaccccccacagcgtgtgggtgttcgcctgcgcccccgacagatgcccccccaccgccctgtacgtggccggcgtgcccgagctgggcgccttcttcagcatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagagcctgatcgacaccaaggtgaaggagatcagcaaccaggagcccctgaagctgtga

SEQ ID NO: 4907 - RNA, 1287 nt, synthetic construct
  misc_feature 1..1287: note = derived and/or modified CDS sequence (opt4) from ANDV(9718133)__AF482712.1__N
  source 1..1287: mol_type = other RNA
atgagcaccctgcaggagctgcaggagaacatcaccgcccacgagcagcagctggtgaccgccagacagaagctgaaggacgccgagaaggccgtggaggtggaccccgacgacgtgaacaagagcaccctgcagaacagaagagccgccgtgagcaccctggagaccaagctgggcgagctgaagagacagctggccgacctggtggccgcccagaagctggccaccaagcccgtggaccccaccggcctggagcccgacgaccacctgaaggagaagagcagcctgagatacggcaacgtgctggacgtgaacagcatcgacctggaggagcccagcggccagaccgccgactggaaggccatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacgtgagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcggcttcttcgtgaaggactggatggacagaatcgaggagttcctggccgccgagtgccccttcctgcccaagcccaaggtggccagcgaggccttcatgagcaccaacaagatgtacttcctgaacagacagagacaggtgaacgagagcaaggtgcaggacatcatcgacctgatcgaccacgccgagaccgagagcgccaccctgttcaccgagatcgccaccccccacagcgtgtgggtgttcgcctgcgcccccgacagatgcccccccaccgccctgtacgtggccggcgtgcccgagctgggcgccttcttcagcatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagagcctgatcgacaccaaggtgaaggagatcagcaaccaggagcccctgaagctgtga

SEQ ID NO: 4908 - RNA, 1278 nt, synthetic construct
  misc_feature 1..1278: note = derived and/or modified CDS sequence (opt4) from Araraquara virus(9480)__KP202360.1__N
  source 1..1278: mol_type = other RNA
atgagcaacctgcaggagctgcaggagaacatcaccgcccacgagcagcagctggtgaccgccagacagaagctgaaggacgccgagaaggccgtggacgtggaccccgacgaggtgaacaagagcaccctgcagggcagaagagccgccgtgagcaccctggagaccaagctgggcgagctgaagagacagctggccgacctggtggccgcccagagactggccagcaagcccgtggaccccaccggcatcgagcccgacgaccacctgaaggagaagagcagcctgagatacggcaacgtgctggacgtgaacagcatcgacctggaggagcccagcggccagaccgccgactggaaggccatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacatcagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcgccttcttcgtgaaggactggatggagagaatcgaggacttcctggccagcgagtgccccttcctgcccaagcccaagaaccccagcgaggccttcatggccaccaacaaggcctacttcctgaacagacagaagcaggtggacgagagccaggtgcccgacatcgtggacctgatcgaccacgccgaggccgagagcgccaccctgttcaaggagatcgccagcccccacagcgtgtgggtgttcgcctgcgcccccgacagatgcccccccaccgccctgtacgtggccggcatgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagagcctgatcgacaccaaggtgaaggagagccagaccaagagcctgtga

SEQ ID NO: 4909 - RNA, 1287 nt, synthetic construct
  misc_feature 1..1287: note = derived and/or modified CDS sequence (opt4) from Araraquara-like virus(P5/Cajuru)__EF571895.1__N
  source 1..1287: mol_type = other RNA
atgagcaacctgcaggagctgcaggagaacatcaccgcccacgagcagcagctggtgaccgccagacagaagctgaaggacgccgagaaggccgtggacgtggaccccgacgaggtgaacaagagcaccctgcagggcagaagagccgccgtgagcaccctggagaccaagctgggcgagctgaagagacagctggccgacctggtggccgcccagagactggccagcaagcccgtggaccccaccggcatcgagcccgacgaccacctgaaggagaagagcagcctgagatacggcaacgtgctggacgtgaaccccatcgacctggaggagcccagcggccagaccgccgactggaaggccatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacatcagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcggcttcttcgtgaaggactggatggagagaatcgaggacttcctggccagcgagtgccccttcctgcccaagcccaagaaccccagcgaggccttcatggccaccaacaaggcctacttcctgaacagacagaagcaggtggacgagagccaggtgcccgacatcgtggacctgatcgaccacgccgaggccgagagcgccaccctgttcaaggagatcgccagcccccacagcgtgtgggtgttcgcctgcgcccccgacagatgcccccccaccgccctgtacgtggccggcctgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagagcctgatcgacaccaaggtgaaggagatcagcaaccagggccccctgaagctgtga

SEQ ID NO: 4910 - RNA, 1287 nt, synthetic construct
  misc_feature 1..1287: note = derived and/or modified CDS sequence (opt4) from BMJV(Oc22531)__AF482713.1__N
  source 1..1287: mol_type = other RNA
atgagcaccctgcaggagctgcaggagaacatcaccgcccacgagcagcagctggtgaccgccagacagaagctgaaggacgccgagaagaccgtggaggtggaccccgacgaggtgaacaagagcaccctgcagagcagaagagccgccgtgagcaccctggagaccaagctgggcgagctgaagagacagctggccgacctggtggccgcccagaagctggccaccaagcccgtggaccccaccggcctggagcccgacgaccacctgaaggagaagagcagcctgagatacggcaacgtgctggacgtgaacagcatcgacctggaggagcccagcggccagaccgccgactggagaagcatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacgtgagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcagcttcttcgtgaaggactggatggagagaatcgaggacttcctggccgccgagtgccccttcctgcccaagcccaaggcccccagcgaggccttcatggccaccaacaaggcctacttcctgaacagacagagacaggtgaacgagagcaaggtgcaggacatcgtggacctgatcgaccacgccgagaccgagagcgccaccctgttcaccgacatcgccaccccccacagcgtgtgggtgttcgcctgcgcccccgacagatgcccccccaccgccctgtacgtggccggcgtgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagagcctgatcgacaccaaggtgaaggagatcagcaaccaggagcccctgaagctgtga

SEQ ID NO: 4911 - RNA, 1287 nt, synthetic construct
  misc_feature 1..1287: note = derived and/or modified CDS sequence (opt4) from LECV(22819)__AF482714.1__N
  source 1..1287: mol_type = other RNA
atgagcaccctgcaggagctgcaggagaacatcaccgcccacgagcagcagctggtgaccgccagacagaagctgaaggacgccgagaagaccgtggaggtggaccccgacgaggtgaacaagagcaccctgcagagcagaagagccgccgtgagcaccctggagaccaagctgggcgagctgaagagacagctggccgacctggtggccgcccagaagctggccaccaagcccgtggaccccaccggcctggagcccgacgaccacctgaaggagaagagcagcctgagatacggcaacgtgctggacgtgaacagcatcgacctggaggagcccagcggccagaccgccgactggagaagcatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacgtgagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcagcttcttcgtgaaggactggatggagagaatcgaggacttcctggccgccgagtgccccttcctgcccaagcccaaggcccccagcgaggccttcatggccaccaacaaggcctacttcctgaacagacagagacaggtgaacgagagcaaggtgcaggagatcgtggacctgatcgaccacgccgagaccgagagcgccaccctgttcaccgacatcgccaccccccacagcgtgtgggtgttcgcctgcgcccccgacagatgcccccccaccgccctgtacgtggccggcgtgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagagcctgatcgacaccaaggtgaaggagatcagcaaccaggagcccctgaagctgtga

SEQ ID NO: 4912 - RNA, 1287 nt, synthetic construct
  misc_feature 1..1287: note = derived and/or modified CDS sequence (opt4) from MCLV(13796)__AF482716.1__N
  source 1..1287: mol_type = other RNA
atgagcaacctgcaggagctgcaggagaacatcaccgcccacgagcagcagctggtgaccgccagacagaagctgaaggacgccgagaaggccgtggacgtggaccccgacgaggtgaacaagagcaccctgcagggcagaagagccgccgtgagcaccctggagaccaagctgggcgagctgaagagacagctggccgacctggtggccgcccagaagctggccaccaagcccgtggaccccaccggcatcgagcccgacgaccacctgaaggagaagagcagcctgagatacggcaacgtgctggacgtgaacagcatcgacctggaggagcccagcggccagaccgccgactggaaggccatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacatcagcatgcccaccgcccagagcaccatgaaggccgaggagatcacccccggcagattcagaaccatcgtgtgcggcctgttccccgcccaggtgaaggccagaaacatcatcagccccgtgatgggcgtgatcggcttcagcttcttcgtgaaggactggatggagagaatcgagggcttcctggccgccgagtgccccttcctgcccaagcccaagaccgccgccgagaccttcatggccaccaacaaggcctacttcttcaacagacagagacaggtggacgagagccaggtgcccgacatcgtggagctgatcgaccaggccgagagcgagagcgccaccctgttcaccgagatcgccagcccccacagcgtgtgggtgttcgcctgcgcccccgacagatgcccccccaccgccctgtacgtggccggcgtgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccaggccctgatcgacaccaaggtgaaggagatcagcaaccaggagcccctgaagctgtga

SEQ ID NO: 4913 - RNA, 1287 nt, synthetic construct
  misc_feature 1..1287: note = derived and/or modified CDS sequence (opt4) from Neembucu(Neembucu)__DQ345763.1__N
  source 1..1287: mol_type = other RNA
atgagcaccctgcaggagctgcaggagaacatcaccgcccacgagcagcagctggtgaccgccagacagaagctgaaggacgccgagaagaccgtggaggtggaccccgacgaggtgaacaagagcaccctgcagagcagaagagccgccgtgagcaccctggagaccaagctgggcgagctgaagagacagctggccgacctggtggccgcccagaagctggccaccagacccgtggaccccaccggcctggagcccgacgaccacctgaaggagaagagcagcctgagatacggcaacgtgctggacgtgaacagcatcgacctggaggagcccagcggccagaccgccgactggagaagcatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacgtgagcatgcccaccgcccagagcaccatgaaggccgaggagatcacccccggcagactgagaaccatcgcctgcggcctgttccccgcccaggtgaaggccagaagcatcatcagccccgtgatgggcgtgatcggcttcagcttcttcgtgaaggactggatggagagaatcgaggacttcctggccgccgagtgccccttcctgcccaagcccaaggcccccagcgaggccttcatggccaccaacaaggcctacttcctgaacagacagagacaggtgaacgagagcaaggtgcaggacatcgtggacctgatcgaccacgccgagaccgagagcgccaccctgttcaccgacatcgccaccccccacagcgtgtgggtgttcgcctgcgcccccgacagatgcccccccaccgccctgtacgtggccggcgtgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagagcctgatcgacaccaaggtgaaggagatcagcaaccaggagcccctgaagctgtga

SEQ ID NO: 4914 - RNA, 1287 nt, synthetic construct
  misc_feature 1..1287: note = derived and/or modified CDS sequence (opt4) from ORNV(22996)__AF482715.1__N
  source 1..1287: mol_type = other RNA
atgagcaccctgcaggagctgcaggagaacatcaccgcccacgagcagcagctggtgaccgccagacagaagctgaaggacgccgagaagaccgtggaggtggaccccgacgaggtgaacaagagcaccctgcagagcagaagagccgccgtgagcaccctggagaccaagctgggcgagctgaagagacagctggccgacctggtggccgcccagaagctggccaccaagcccgtggaccccaccggcctggagcccgacgaccacctgaaggagaagagcagcctgagatacggcaacgtgctggacgtgaacagcatcgacctggaggagcccagcggccagaccgccgactggaaggccatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacgtgagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcagcttcttcgtgaaggactggatggagagaatcgaggacttcctggccgccgagtgccccttcctgcccaagcccaaggccctgagcgaggccttcatggccaccaacaaggcctacttcctgaacagacagagacaggtgaacgacagcaaggtgcaggacatcgtggacctgatcgaccacgccgagatcgagagcgccaccctgttcaccgacatcgccaccccccacagcgtgtgggtgttcgcctgcgcccccgacagatgcccccccaccgccctgtacgtggccggcgtgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagagcctgatcgacaccaaggtgaaggagatcagcaaccaggagcccctgaagctgtga

SEQ ID NO: 4915 - RNA, 1287 nt, synthetic construct
  misc_feature 1..1287: note = derived and/or modified CDS sequence (opt4) from PRGV(14403)__AF482717.1__N
  source 1..1287: mol_type = other RNA
atgagcaccctgcaggagctgcaggagaacatcaccgcccacgagcagcacctggtgaccgccagacagaagctgaaggacgccgagaagaccgtggaggtggaccccgacgaggtgaacaagagcaccctgcagagcagaagagccgccgtgagcaccctggagaccaagctgggcgagctgaagagacagctggccgacctggtggccgcccagaagctggccgccaagcccgtggaccccaccggcctggagcccgacgaccacctgaaggagaagagcagcctgagatacggcaacgtgctggacgtgaacagcatcgacctggaggagcccagcggccagaccgccgactggaaggccatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacgtgagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcagcttcttcgtgaaggactggatggagagaatcgaggacttcctggccgccgagtgccccttcctgcccaagcccaagaccaccagcgaggccttcatgagcaccaacaaggcctacttcctgaacagacagagacaggtggacgagagccaggtgcccgacatcgccgagctgatcgagcaggccgagagcgagagcgccaccctgttcaccgagatcgccagcccccacagcgtgtgggtgttcgcctgcgcccccgacagatgcccccccaccgccctgtacgtggccggcgtgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccaggccctgatcgacaccaaggtgaaggagatcagcaaccaggagcccctgaagctgtga

SEQ ID NO: 4916 - RNA, 1287 nt, synthetic construct
  misc_feature 1..1287: note = derived and/or modified CDS sequence (opt4) from TUNV(FVB554)__JF750419.1__N
  source 1..1287: mol_type = other RNA
atgagcaacctgcaggagctgcaggagaacatcaccgcccacgagcagcagctggtgaccgccagacagaagctgaaggacgccgagaaggccgtggagatggaccccgacgacgtgaacaagagcaccctgcagagcagaagagccgccgtgagcaccctggagaccaagctgggcgagctgaagagacagctggccgacatggtggccgcccagaagctggccaccaagcccgtggaccccaccggcctggagcccgacgaccacctgaaggagaagagcagcctgagatacggcaacgtgctggacgtgaacagcatcgacctggaggagcccagcggccagaccgccgactggaagagcatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacgtgagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcagcttcttcgtgaaggactggatggagagaatcgaggacttcctggccgacgagtgccccttcctgcccaagcccaagagccccagcgaggccttcatggccaccaacaaggcctacttcctgaacagacagagacaggtgaacgacagcaaggtgcaggacatcgtggacctgatcgaccacgccgagaccgagagcgccaccctgttcaccgacatcgccaccccccacagcgtgtgggtgttcgcctgcgcccccgacagatgcccccccaccgccctgtacgtggccggcgtgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccaggccctgatcgacaccaaggtgaaggagatcagcaaccaggagcccctgaagctgtga

SEQ ID NO: 4917 - RNA, 1287 nt, synthetic construct
  misc_feature 1..1287: note = derived and/or modified CDS sequence (opt4) from BCCV(BCCV)__AB689163.1__N
  source 1..1287: mol_type = other RNA
atgagcaacctgaaggaggtgcaggacaacatcaccacccacgagcagcagctggtggccgccagacagaagctgaaggacgccgagagaaccgtgggcgtggaccccgacgacgtgaacaagagcaccctgcagaacagaagagccgccgtgagcgccctggaggccaagatcggcgagctgaagagacagctggccgacctggtggccgcccagaagctggccaccaagagcgtggaccccaccggcatcgagcccgacgaccacctgaaggagaagagcagcctgagatacggcaacgtgctggacgtgaacagcatcgacctggaggagcccagcggccagaccgccgactggaaggccatcggcacctacatcctgagcttcgtgctgcccatcgtgctgaaggccctgtacatgctgagcaccagaggcagacagaccgtgaaggagaacaagggcaccagaatcagattcaaggacgacagcagctacgaggacgtgaacggcatcagaaagcccaagcacctgtacgtgagcctgcccaccgcccagagcaccatgaaggccgacgagatcacccccggcagattcagaaccatcgtgtgcggcctgttccccgcccagatcaaggccagaaacatcatcagccccgtgatgggcgtgatcggcttcagcttcttcgtgaaggactgggtggacaagatcgaggacttcctgagagccgagtgccccttcctgcccaagcccagagcccaggccgagagcttcctgagcaccaacggcgcctacttcatgaacagacagacccaggtggaggagagcaaggtgcaggacatcctggacctgatcgacaccgccgagagcggcggcgccaccctgttcgacaacatcgccagcccccagagcgcctggatcttcgcctgcgcccccgacagatgcccccccaccgccctgtacgtggccggcgtgcccgagctgggcgccttcttcagcatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgatcaactggggcaaggaggccgtgaaccacttccacctgggcgacgacatggaccccgagctgagacagctggcccaggccctggtggacaccaaggtgaaggagatcagcaaccaggagcccctgaagatctga

SEQ ID NO: 4918 - RNA, 1287 nt, synthetic construct
  misc_feature 1..1287: note = derived and/or modified CDS sequence (opt4) from BCCV(BCCV)__L39949.1__N
  source 1..1287: mol_type = other RNA
atgagcaacctgaaggaggtgcaggacaacatcaccacccacgagcagcagctggtggccgccagacagaagctgaaggacgccgagagaaccgtggaggtggaccccgacgacgtgaacaagagcaccctgcagaacagaagagccgccgtgagcgccctggaggccaagatcggcgagctgaagagacagctggccgacctggtggccgcccagaagctggccaccaagagcgtggaccccaccggcatcgagcccgacgaccacctgaaggagaagagcagcctgagatacggcaacgtgctggacgtgaacagcatcgacctggaggagcccagcggccagaccgccgactggaaggccatcggcacctacatcctgagcttcgtgctgcccatcgtgctgaaggccctgtacatgctgagcaccagaggcagacagaccgtgaaggagaacaagggcaccagaatcagattcaaggacgacagcagctacgaggacgtgaacggcatcagaaagcccaagcacctgtacgtgagcctgcccaccgcccagagcaccatgaaggccgacgagatcacccccggcagattcagaaccatcgtgtgcggcctgttccccgcccagatcaaggccagaaacatcatcagccccgtgatgggcgtgatcggcttcagcttcttcgtgaaggactgggtggacaagatcgaggacttcctgagagccgagtgccccttcctgcccaagcccagagcccaggccgagagcttcctgagcaccaacggcgcctacttcatgaacagacagacccaggtggaggagagcaaggtgcaggacatcctggacctgatcgacaccgccgagagcggcggcgccaccctgttcgacaacatcgccagcccccagagcgcctggatcttcgcctgcgcccccgacagatgcccccccaccgccctgtacgtggccggcgtgcccgagctgggcgccttcttcagcatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgatcaactggggcaaggaggccgtgaaccacttccacctgggcgacgacatggaccccgagctgagacagctggcccaggccctggtggacaccaaggtgaaggagatcagcaaccaggagcccctgaagatctga

SEQ ID NO: 4919 - RNA, 1290 nt, synthetic construct
  misc_feature 1..1290: note = derived and/or modified CDS sequence (opt4) from DOBV(DOBV/Ano-Poroia/Afl9/1999)__NC_005233.1__N
  source 1..1290: mol_type = other RNA
atggccaccctggaggagctgcagaaggagatcaacaaccacgagggccagctggtgatcgccagacagaaggtgaaggacgccgagaagcagtacgagaaggaccccgacgacctgaacaagagagccctgagcgacagagagagcatcgcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctgatcagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacctgatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgaagaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4920 - RNA, 1290 nt, synthetic construct
  misc_feature 1..1290: note = derived and/or modified CDS sequence (opt4) from DOBV(DOB/Saaremaa/160V)__AJ009773.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcatcgcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccgtgtgcggcctgtaccccgcccaggtgaaggccagaaacctgatcagccccgtgatgagcgtgatcggcttcctgaccctggccaagaactggaccgagagagtggaggagtggctggacctgccctgcaagctgctgagcgagcccagccccaccagcctgaccaagggccccagcaccaacagagactacctgagccagagacagggcgccctggccaagatggagaccaaggaggcccaggtggtgagaaagcacgccatcgacgccggctgcaacatcatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatgatcgagtggggcaaggaggccgtggacagcttccacctgggcgacgacatggaccccgagatcagaagcctggcccaggccctgatcgaccagaaggtgaaggagatcagcaaccaggagcccctgaagctgtga

SEQ ID NO: 4921 - RNA, 1290 nt, synthetic construct
  misc_feature 1..1290: note = derived and/or modified CDS sequence (opt4) from DOBV(Slovakia/400Af/98)__AY168576.1__N
  source 1..1290: mol_type = other RNA
atggccaccctggaggagctgcagaaggagatcaacaaccacgagggccagctggtgatcgccagacagaaggtgaaggacgccgagaagcagtacgagaaggaccccgacgacctgaacaagagagccctgagcgacagagagagcatcgcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctgatcagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacctgatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgaagaagaagagcagcttctaccagagcctgctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4922 - RNA, 1290 nt, synthetic construct
  misc_feature 1..1290: note = derived and/or modified CDS sequence (opt4) from DOBV(Slovakia-856-Aa)__AJ269549.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagagcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcatggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacatcatcgaccacatcgacagccccagcagcatctgggtgttcgcccccgcccccgacagatgcccccccacctgcctgttcatcgccggcatggccgagctgggcgccttcttcagcgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4923 - RNA, 1290 nt, synthetic construct
  misc_feature 1..1290: note = derived and/or modified CDS sequence (opt4) from DOBV(Slovakia-862-Aa)__AJ269550.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagagcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcatggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacatcatcgaccacatcgacagccccagcagcatctgggtgttcgccggcagacccgacagatgcccccccacctgcctgttcatcgccggcatggccgagctgggcgccttcttcagcgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4924 - RNA, 1290 nt, synthetic construct
  misc_feature 1..1290: note = derived and/or modified CDS sequence (opt4) from DOBV(Esl/29Aa/01)__AY533118.2__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagagcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacatcatcgaccacatcgacagccccagcagcatctgggtgttcgccggcgcccccgacagatgcccccccacctgcctgttcatcgccggcatggccgagctgggcgccttcttcagcgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4925 - RNA, 1290 nt, synthetic construct
  misc_feature 1..1290: note = derived and/or modified CDS sequence (opt4) from DOBV(Kurkino/44Aa/98)__AJ131672.1__N
  source 1..1290: mol_type = other RNA
atggccaccctggaggagctgcagaaggagatcaacagccacgagggccagctggtgatcgccagacagaaggtgaaggacgccgagaagcagcacgagaaggaccccgacgacctgaacaagagagccctgagcgacagagagagcgtggcccagagcatccagagcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacaggccgccctggccaagatggagaccaaggaggcccaggccgtgagaaagcacgccatcgacgccggctgcaccatcatcgactacatcgacagccccagcagcatctgggtgttcgccggcgcccccgacagatgcccccccacctgcctgttcatcgccggcatggccgagctgggcgccttcttcagcgtgctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaacagagagcccctgaagctgtga

SEQ ID NO: 4926 - RNA, 1290 nt, synthetic construct
  misc_feature 1..1290: note = derived and/or modified CDS sequence (opt4) from DOBV(Kurkino/53Aa/98)__AJ131673.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagagcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacaggccgccctggccaagatggagaccaaggaggcccaggccgtgagaaagcacgccatcgacgccggctgcaccatcatcgaccacatcgacagccccagcagcatctgggtgttcgccggcgcccccgacagatgcccccccacctgcctgttcatcgccggcatggccgagctgggcgccttcttcagcgtgctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaacagagagcccctgaagctgtga

SEQ ID NO: 4927 - RNA, 1290 nt, synthetic construct
  misc_feature 1..1290: note = derived and/or modified CDS sequence (opt4) from DOBV(Saar/90Aa/97)__AJ009775.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcatcgcccagagcatccagggcaagatcgacgagctgagaagacagctggccgacagagtggccgccggcaagaacatcggcagagagagagaccccaccggcctggaccccggcgaccacctgaaggagaagagcatgctgagctacggcaacgtgatcgacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccgtgtgcggcctgtaccccgcccaggtgaaggccagaaacctgatcagccccgtgatgagcgtgatcggcttcctgaccctggccaagaactggaccgagagagtggaggagtggctggacctgccctgcaagctgctgagcgagcccagccccaccagcctgaccaagggccccagcaccaacagagactacctgagccagagacagggcgccctggccaagatggagaccaaggaggcccaggccgtgagaaagcacgccatcgacgccggctgcaacatcatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatgatcgagtggggcaaggaggccgtggacagcttccacctgggcgacgacatggaccccgagatcagaagcctggcccaggccctgatcgaccagaaggtgaaggagatcagcaaccaggagcccctgaagctgtga

SEQ ID NO: 4928 - RNA, 1290 nt, synthetic construct
  misc_feature 1..1290: note = derived and/or modified CDS sequence (opt4) from DOBV(SK/Aa)__AY961615.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagaaccctgagcgacagagagagcgtggcccagagcatccagagcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacatcatcgaccacatcgacagccccagcagcatctgggtgttcgccggcgcccccgacagatgcccccccacctgcctgttcatcgccggcatggccgagctgggcgccttcttcagcgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4929 - RNA, 1290 nt, synthetic construct
  misc_feature 1..1290: note = derived and/or modified CDS sequence (opt4) from DOBV(A35)__GU904030.1__N
  source 1..1290: mol_type = other RNA
atggccaccctggaggagctgcagaaggagatcaacaaccacgagggccagctggtgatcgccagacagaaggtgaaggacgccgagaagcagtacgagaaggaccccgacgacctgaacaagagagccctgagcgacagagagagcatcgcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctgatcagccccgtgatgagcgtgatcggcttcgtggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacctgatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgaagaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4930 - RNA, 1290 nt, synthetic construct
  misc_feature 1..1290: note = derived and/or modified CDS sequence (opt4) from DOBV(3970/87)__L41916.1__N
  source 1..1290: mol_type = other RNA
atggccaccctggaggagctgcagaaggagatcaacaaccacgagggccagctggtgatcgccagacagaaggtgaaggacgccgagaagcagtacgagaaggaccccgacgacctgaacaagagagccctgagcgacagagagagcatcgcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctgatcagccccgtgatgagcgtgatcggcttcgtggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacctgatcgaccacatcgacagccccagcagcatctgggtgttcgccggcgcccccgacagatgcccccccacctgcctgttcatcgccggcatggccgagctgggcgccttcttcgcctgcctgcaggacatgagaaacaccatcatggccagcaagaccatcggcaccagcgaggagaagctgaagaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4931 - RNA, 1290 nt, synthetic construct
  misc_feature 1..1290: note = derived and/or modified CDS sequence (opt4) from DOBV(Klyuch-2000)__AF442622.1__N
  source 1..1290: mol_type = other RNA
atggccaccctggaggagctgcagaaggagatcaacagccacgagggccagctggtgatcgccagaagaaaggtgaaggacgccgagaagcagtacgagaaggaccccgacgacctgaacaagagagccctgagcgacagagagagcgtggcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccgtgtgcggcctgtaccccgcccaggtgaaggccagaaacctggtgagccccgtgatgagcgtgatcggcttcgtgagcctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcaacgccggctgcaacctggtggaccacatcgacagccccagcagcatctgggtgttcgccggcgcccccgacagatgcccccccacctgcctgttcgtggccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgagcagaaggtgaaggagatcagcaaccaggagcccctgaagctgtga

SEQ ID NO: 4932 - RNA, 1290 nt, synthetic construct
  misc_feature 1..1290: note = derived and/or modified CDS sequence (opt4) from DOBV(10636/Ap)__KP878311.1__N
  source 1..1290: mol_type = other RNA
atggccaccctggaggagctgcagaaggagatcaacaaccacgagggccagctggtgatcgccagacagaaggtgaaggacgccgagaagcagtacgagaaggaccccgacgacctgaacaagagagccctgagcgacagagagagcgtggcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccgtgtgcggcctgtaccccgcccaggtgaaggccagaaacctggtgagccccgtgatgagcgtgatcggcttcgtgagcctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacctggtggaccacatcgacagccccagcagcatctgggtgttcgccggcgcccccgacagatgcccccccacctgcctgttcgtggccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaagcctggcccaggccctgatcgaccagaaggtgaaggagatcagcaaccaggagcccctgaagctgtga

SEQ ID NO: 4933 - RNA, 1290 nt, synthetic construct
  misc_feature 1..1290: note = derived and/or modified CDS sequence (opt4) from DOBV(10645/Ap)__KP878312.1__N
  source 1..1290: mol_type = other RNA
atggccaccctggaggagctgcagaaggagatcaacaaccacgagggccagctggtgatcgccagacagaaggtgaaggacgccgagaagcagtacgagaaggaccccgacgacctgaacaagagagccctgagcgacagagagagcgtggcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccgtgtgcggcctgtaccccgcccaggtgaaggccagaaacctggtgagccccgtgatgagcgtgatcggcttcgtgagcctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacctggtggaccacatcgacagccccagcagcatctgggtgttcgccggcgcccccgacagatgcccccccacctgcctgttcgtggccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4934 - RNA, 1290 nt, synthetic construct
  misc_feature 1..1290: note = derived and/or modified CDS sequence (opt4) from DOBV(Aa1854/Lipetsk-02)__EU188452.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagagcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacaggccgccctggccaagatggagaccaaggaggcccaggccgtgagaaagcacgccatcgacgccggctgcaccatcatcgaccacatcgacagccccagcagcatctgggtgttcgccggcgcccccgacagatgcccccccacctgcctgttcatcgccggcatggccgagctgggcgccttcttcagcgtgctgcaggacatgagaaacaccatcatggccagcaagcccgtgggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4935 - RNA, 1290 nt, synthetic construct
  misc_feature 1..1290: note = derived and/or modified CDS sequence (opt4) from DOBV(Ap/Sochi/43)__JF920151.1__N
  source 1..1290: mol_type = other RNA
atggccaccctggaggagctgcagaaggagatcaacaaccacgagggccagctggtgatcgccagacagaaggtgaaggacgccgagaagcagtacgagaaggaccccgacgacctgaacaagagagccctgagcgacagagagagcgtggcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccgtgtgcggcctgtaccccgcccaggtgaaggccagaaacctggtgagccccgtgatgagcgtgatcggcttcgtgagcctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacctggtggaccacatcgacagccccagcagcatctgggtgttcgccggcgcccccgacagatgcccccccacctgcctgttcgtggccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccacagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4936 - RNA, 1290 nt, synthetic construct
  misc_feature 1..1290: note = derived and/or modified CDS sequence (opt4) from DOBV(Ap/Sochi/hu)__JF920150.1__N
  source 1..1290: mol_type = other RNA
atggccaccctggaggagctgcagaaggagatcaacaaccacgagggccagctggtgatcgccagacagaaggtgaaggacgccgagaagcagtacgagaaggaccccgacgacctgaacaagagagccctgagcgacagagagagcgtggcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccgtgtgcggcctgtaccccgcccaggtgaaggccagaaacctggtgagccccgtgatgagcgtgatcggcttcctgagcctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacctggtggaccacatcgacagccccagcagcatctgggtgttcgccggcgcccccgacagatgcccccccacctgcctgttcgtggccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccacagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4937 - RNA, 1290 nt, synthetic construct
  misc_feature 1..1290: note = derived and/or modified CDS sequence (opt4) from DOBV(Ap1584/Sochi-01)__EU188449.1__N
  source 1..1290: mol_type = other RNA
atggccaccctggaggagctgaagaaggagatcaacaaccacgagggccagctggtgatcgccagacagaaggtgaaggacgccgagaagcagtacgagaaggaccccgacgacctgaacaagagagccctgagcgacagagagagcgtggcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccgtgtgcggcctgtaccccgcccaggtgaaggccagaaacctggtgagccccgtgatgagcgtgatcggcttcgtgagcctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacctggtggaccacatcgacagccccagcagcatctgggtgttcgccggcgcccccgacagatgcccccccacctgcctgttcgtggccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4938 - RNA, 1290 nt, synthetic construct
  misc_feature 1..1290: note = derived and/or modified CDS sequence (opt4) from DOBV(DOB/Gola/235Af/07)__KC848495.1__N
  source 1..1290: mol_type = other RNA
atggccaccctggaggagctgcagaaggagatcaacaaccacgagggccagctggtgatcgccagacagaaggtgaaggacgccgagaagcagtacgagaaggaccccgacgacctgaacaagagagccctgagcgacagagagagcatcgcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcagaaaggccgacgagatcacccccggcagattcagaaccgccatctgcggcctgtaccccgcccaggtgaaggccagaaacctgatcagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacctgatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgaagaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4939 - RNA, 1290 nt, synthetic construct
  misc_feature 1..1290: note = derived and/or modified CDS sequence (opt4) from DOBV(DOB/Gola/343Af/07)__KC848498.1__N
  source 1..1290: mol_type = other RNA
atggccaccctggaggagctgcagaaggagatcaacaaccacgagggccagctggtgatcgccagacagaaggtgaaggacgccgagaagcagtacgagaaggaccccgacgacctgaacaagagagccctgagcgacagagagagcatcgcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctgatcagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccaccgacgccggctgcaacctgatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgaagaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4940 - RNA, 1290 nt, synthetic construct
  misc_feature 1..1290: note = derived and/or modified CDS sequence (opt4) from DOBV(DOB/Pecs/27Aa/06)__KC848499.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagagcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagagtgagattcaaggacgacagcagcttcgaggacgtgaacggcatcagaaagcccaagcacctgttcctgagcatgcccaacgcccagagcagcatgaaggccgacgagatcacccccggcagattcagaaccgccgtgtgcggcctgtaccccgcccaggtgaaggccagaaacctggtgagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacatcatcgaccacatcgacagccccagcagcatctgggtgttcgccggcgcccccgacagatgcccccccacctgcctgttcatcgccggcatggccgagctgggcgccttcttcagcgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4941 - RNA, 1290 nt, synthetic construct
  misc_feature 1..1290: note = derived and/or modified CDS sequence (opt4) from DOBV(DOB/Pecs/31Aa/06)__KC848500.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagagcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccgtgtgcggcctgtaccccgcccaggtgaaggccagaaacctggtgagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacatcatcgaccacatcgacagccccagcagcatctgggtgttcgccggcgcccccgacagatgcccccccacctgcctgttcatcgccggcatggcccagctgggcgccttcttcagcgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaagatgaaggagatcagcaaccaggagcccctgaagctgtga

SEQ ID NO: 4942 - RNA, 1290 nt, synthetic construct
  misc_feature 1..1290: note = derived and/or modified CDS sequence (opt4) from DOBV(DOB/Sarmellek/77Aa/06)__KC848501.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagagcaagatcgacgagctgagaagacagctggccgacagagtggccagcggcaagaacatcggcaaggagagagaccccaccggcctggaccccggcgaccacctgaccgagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacatcatcgaccacatcgacagccccagcagcatctgggtgttcgccggcgcccccgacagatgcccccccacctgcctgttcatcgccggcatggccgagctgggcgccttcttcagcgtgctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaagcctggcccaggccctgatcgaccagaaggtgaaggagatcagcaaccaggagcccctgaagctgtga

SEQ ID NO: 4943 - RNA, 1290 nt, synthetic construct
  misc_feature 1..1290: note = derived and/or modified CDS sequence (opt4) from DOBV(GER/05/239/Aa)__GQ205405.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgagccagagacagggcgccctggccaagatggagaccaaggaggcccaggccgtgagaaagcacgccatcgacgccggctgcaacatcatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaagcctggcccaggccctgatcgaccagaaggtgaaggagatcagcaaccaggagcccctgaagctgtga

SEQ ID NO: 4944 - RNA, 1290 nt, synthetic construct
  misc_feature 1..1290: note = derived and/or modified CDS sequence (opt4) from DOBV(GER/05/477/Af)__GQ205406.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcctggccctggccaagaactggaccgagagagtggaggagtggctggacctgccctgcaagctgatcagcgagcccagccccaccagcctgaccaagggccccagcaccaacagagactacctgagccagagacagggcgccctggccaagatggagaccaaggaggcccaggccgtgagaaagcacgccatcgacgccggctgcaacatcatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaagcctggcccaggccctgatcgaccagaaggtgaaggagatcagcaaccaggagcccctgaagctgtga

SEQ ID NO: 4945 - RNA, 1290 nt, synthetic construct
  misc_feature 1..1290: note = derived and/or modified CDS sequence (opt4) from DOBV(GER/07/293/Aa)__GQ205401.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcctggccctggccaagaactggaccgagagagtggaggactggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacatcatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgctgatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4946 - RNA, 1290 nt, synthetic construct
  misc_feature 1..1290: note = derived and/or modified CDS sequence (opt4) from DOBV(GER/07/424/Aa)__GQ205403.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcctggccctggccaagaactggaccgagagagtggaggactggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacatcatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4947 - RNA, 1290 nt, synthetic construct
  misc_feature 1..1290: note = derived and/or modified CDS sequence (opt4) from DOBV(GER/08/118/Aa)__GQ205407.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctggtgagccccgtgatgagcgtgatcggcttcctggccctggccaagaactggaccgagagagtggaggactggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacatcatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccgtgggcaccagcgaggagaagatgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4948 - RNA, 1290 nt, synthetic construct
  misc_feature 1..1290: note = derived and/or modified CDS sequence (opt4) from DOBV(GER/08/131/Af)__GQ205408.1__N
  source 1..1290: mol_type = other RNA
atggccaccctggaggagctgcagaaggagatcaacagccacgagggccagctggtgatcgccagacagaaggtgaaggacgccgagaagcagtacgagaaggaccccgacgacctgaacaagagagccctgagcgacagagagagcgtggcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccgtgtgcggcctgtaccccgcccaggtgaaggccagaaacctggtgagccccgtgatgagcgtgatcggcttcctggccctggccaagaactggaccgagagagtggaggactggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacatcatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgagaaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtga

SEQ ID NO: 4949 - RNA, 1290 nt, synthetic construct
  misc_feature 1..1290: note = derived and/or modified CDS sequence (opt4) from HTNV(76-118/POR)__KT885049.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccaacagagagggcgtggccgtgagcatccaggccaagatcgacgagctgaagatgcagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcatcgtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgatcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4950 - RNA, 1290 nt, synthetic construct
  misc_feature 1..1290: note = derived and/or modified CDS sequence (opt4) from HTNV(A16)__AF288646.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcctggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccaacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgtgctgagaaccctggcccagagcctgatcgacgtgaaggtgaaggagatcagcaaccaggagcccctgaagctgtga

SEQ ID NO: 4951 - RNA, 1290 nt, synthetic construct
  misc_feature 1..1290: note = derived and/or modified CDS sequence (opt4) from HTNV(CA09082007)__HQ834499.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacatcagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacctgaaggtgaaggagatcagcaaccaggagcccctgaagctgtga

SEQ ID NO: 4952 - RNA, 1290 nt, synthetic construct
  misc_feature 1..1290: note = derived and/or modified CDS sequence (opt4) from HTNV(CA10081109)__HQ834500.1__N
  source 1..1290: mol_type = other RNA
atgcccaccagcggcgagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcgagctgtaccccgcccagatcaaggccagcaagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacccccacgccggcgacgacgtggaccccagcctgggcatgctggcccagagcctgatcgacgtgaaggtgaaggagatcagcaaccaggagcccctgaagctgtga

SEQ ID NO: 4953 - RNA, 1290 nt, synthetic construct
  misc_feature 1..1290: note = derived and/or modified CDS sequence (opt4) from HTNV(CA10081113)__HQ834501.1__N
  source 1..1290: mol_type = other RNA
atggccaccagcggcgagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatcttcgagctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacagacacctgatgaacatcgtggaccccgagcccagagccctggcccagagcctgatcgacgtgaaggtgaaggagatcagcaaccaggagcccctgaagctgtga

SEQ ID NO: 4954 - RNA, 1290 nt, synthetic construct
  misc_feature 1..1290: note = derived and/or modified CDS sequence (opt4) from HTNV(CA10081203)__HQ834502.1__N
  source 1..1290: mol_type = other RNA
atggccaccaacggcgagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatcttcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacgagctgcacagcggcgacggcgagcaccacgccagcagaaccctggcccagagcctgatcgacgtgaaggtgaaggagatcagcaaccaggagcccctgaagctgtga

SEQ ID NO: 4955 - RNA, 1290 nt, synthetic construct
  misc_feature 1..1290: note = derived and/or modified CDS sequence (opt4) from HTNV(CA10081206)__HQ834503.1__N
  source 1..1290: mol_type = other RNA
atggccaccatcgaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacgcctgggacggcatggaccccgagctgagaaccctggcccagagcctgatcgacgtgaaggtgaaggagatcagcaaccaggagcccctgaagctgtga

SEQ ID NO: 4956 - RNA, 1290 nt, synthetic construct
  misc_feature 1..1290: note = derived and/or modified CDS sequence (opt4) from HTNV(CA10081708)__HQ834504.1__N
  source 1..1290: mol_type = other RNA
atgcccaccagcggcgagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatcttcgagctgtaccccgcccagatcaaggccagaaagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacccccacaccggcgacgacgccgaccccgagctgagaaccctggcccagagcctgatcgacgtgaaggtgaaggagatcagcaaccaggagcccctgaagctgtga

SEQ ID NO: 4957 - RNA, 1290 nt, synthetic construct
  misc_feature 1..1290: note = derived and/or modified CDS sequence (opt4) from HTNV(CA10081905)__HQ834505.1__N
  source 1..1290: mol_type = other RNA
atggccaccagcggcgagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatcttcgagctgtaccccgcccagatcaaggccagaaagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaaccaccacctgatcaacgccggcgaccacgagctgagaaccctggcccagagcctgatcgacgtgaaggtgaaggagatcagcaaccaggagcccctgaagctgtga

SEQ ID NO: 4958 - RNA, 1290 nt, synthetic construct
  misc_feature 1..1290: note = derived and/or modified CDS sequence (opt4) from HTNV(E142)__AF288644.1__N
  source 1..1290: mol_type = other RNA
atggccaccatggaggagctgcagagagagatcaacgcccacgagggccagctggtgatcgccagacagaaggtgagagacgccgagaagagatacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcagcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggtggtggacaacttccacctgggcgacgacatggaccccgagctgagaaccctggcccagagcctgatcgacgtgaaggtgaaggagatcagcaaccaggagcccctgaagctgtga

SEQ ID NO: 4959 - RNA, 1290 nt, synthetic construct
  misc_feature 1..1290: note = derived and/or modified CDS sequence (opt4) from HTNV(H10150)__HQ834506.1__N
  source 1..1290: mol_type = other RNA
atggccaccatgggcgagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatcttcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaaccaccactgggccaacgccatcggcagcgagctgagaaccctggcccagagcctgatcgacgtgaaggtgaaggagatcagcaaccaggagcccctgaagctgtga

SEQ ID NO: 4960 - RNA, 1290 nt, synthetic construct
  misc_feature 1..1290: note = derived and/or modified CDS sequence (opt4) from HTNV(Aa03-161)__KT935024.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacgccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4961 - RNA, 1290 nt, synthetic construct
  misc_feature 1..1290: note = derived and/or modified CDS sequence (opt4) from HTNV(Aa04-722)__KU207190.1__N
  source 1..1290: mol_type = other RNA
atggccaccatggaggagctgcagagagagatcaacgcccacgagggccagctggtgatcgccagacagaaggtgagagacgccgagagacagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4962 - RNA, 1290 nt, synthetic construct
  misc_feature 1..1290: note = derived and/or modified CDS sequence (opt4) from HTNV(Aa05-190)__KT935027.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4963 - RNA, 1290 nt, synthetic construct
  misc_feature 1..1290: note = derived and/or modified CDS sequence (opt4) from HTNV(Aa10-123)__KT935036.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccaccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcgtggccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4964 - RNA, 1290 nt, synthetic construct
  misc_feature 1..1290: note = derived and/or modified CDS sequence (opt4) from HTNV(Aa10-265)__KU207194.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcgtggccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4965 - RNA, 1290 nt, synthetic construct
  misc_feature 1..1290: note = derived and/or modified CDS sequence (opt4) from HTNV(AA1028)__AF427318.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4966 - RNA, 1290 nt, synthetic construct
  misc_feature 1..1290: note = derived and/or modified CDS sequence (opt4) from HTNV(Aa10-434)__KT935038.1__N
  source 1..1290: mol_type = other RNA
atggccaccatggaggagctgcagagagagatcaacgcccacgagggccagctggtgatcgccagacagaaggtgagagacgccgagaagcagtacggcaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4967 - RNA, 1290 nt, synthetic construct
  misc_feature 1..1290: note = derived and/or modified CDS sequence (opt4) from HTNV(Aa14-362)__KT935049.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagagtggagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4968 - RNA, 1290 nt, synthetic construct
  misc_feature 1..1290: note = derived and/or modified CDS sequence (opt4) from HTNV(Aa14-404)__KT935052.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcagccaggagcccctgaagctgtga

SEQ ID NO: 4969 - RNA, 1290 nt, synthetic construct
  misc_feature 1..1290: note = derived and/or modified CDS sequence (opt4) from HTNV(Aa15-56)__KU207195.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgaacgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4970 - RNA, 1290 nt, synthetic construct
  misc_feature 1..1290: note = derived and/or modified CDS sequence (opt4) from HTNV(AA1719)__AF427319.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatcatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4971 - RNA, 1290 nt, synthetic construct
  misc_feature 1..1290: note = derived and/or modified CDS sequence (opt4) from HTNV(AP1168)__AF427323.1__N
  source 1..1290: mol_type = other RNA
atggccaccatggaggagctgcagaaggagatcaacgcccacgagggccagctggtgatcgccagacagaaggtgagagacgccgagagacagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatggtgagccccgtgatgagcgtgatcggcttcctggccctggccaaggactggggcgacagaatcgagcagtggctgagcgagccctgcaagctgctgcccgacaccgccgccgtgagcctgcacggcggccccgccaccaacagagactacctgagacagagacaggccgccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacctgaaggtgaaggagatcagcaaccaggagcccctgaagctgtga

SEQ ID NO: 4972 - RNA, 1290 nt, synthetic construct
  misc_feature 1..1290: note = derived and/or modified CDS sequence (opt4) from HTNV(AP708)__AF427322.1__N
  source 1..1290: mol_type = other RNA
atggccaccatggaggagctgcagaaggagatcaacgcccacgagggccagctggtgatcgccagacagaaggtgagagacgccgagagacagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatggtgagccccgtgatgagcgtgatcggcttcctggccctggccaaggactggggcgacagaatcgagcagtggctgagcgagccctgcaagctgctgcccgacaccgccgccgtgagcctgcacggcggccccgccaccaacagagactacctgagacagagacaggccgccctgggcaacatggagaccaaggagagcaaggccatcagacagcacgccgagaccgccggctgcagcatgatcgaggacatcgagagccccagcagcgtgtgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacctgaaggtgaaggagatcagcaaccaggagcccctgaagctgtga

SEQ ID NO: 4973 - RNA, 1290 nt, synthetic construct
  misc_feature 1..1290: note = derived and/or modified CDS sequence (opt4) from HTNV(DandongHu-32)__KC570386.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaatcctggcccagagcctgatcgacgtgaaggtgaaggagatcagcaaccaggagcccctgaagctgtga

SEQ ID NO: 4974 - RNA, 1290 nt, synthetic construct
  misc_feature 1..1290: note = derived and/or modified CDS sequence (opt4) from HTNV(DandongHu-34)__KC570387.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatggccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4975 - RNA, 1290 nt, synthetic construct
  misc_feature 1..1290: note = derived and/or modified CDS sequence (opt4) from HTNV(DandongHu-89)__KC570389.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtgcgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4976 - RNA, 1290 nt, synthetic construct
  misc_feature 1..1290: note = derived and/or modified CDS sequence (opt4) from HTNV(DandongHu-91)__KC570390.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgggcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatggccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4977 - RNA, 1290 nt, synthetic construct
  misc_feature 1..1290: note = derived and/or modified CDS sequence (opt4) from HTNV(Fuyuan-Aa-145)__KJ857349.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgcaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4978 - RNA, 1290 nt, synthetic construct
  misc_feature 1..1290: note = derived and/or modified CDS sequence (opt4) from HTNV(Fuyuan-Aa-26)__KJ857347.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgccgtgcccatcctgctgaaggccctgtacatgctgaccaccagaggcagacagaccaccaaggacaacaagggcaccagaatcagattcaaggacgacagcagcctggaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgccccttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4979 - RNA, 1290 nt, synthetic construct
  misc_feature 1..1290: note = derived and/or modified CDS sequence (opt4) from HTNV(JS1)__KP970572.1__N
  source 1..1290: mol_type = other RNA
atggccaccatggaggagctgcagagagagatcaacgcccacgagggccagctggtgatcgccagacagaaggtgagagacgccgagaagcagtacgagaacgaccccgacgagctgaacaagagagccctgaccaacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcatcgtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgatcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4980 - RNA, 1290 nt, synthetic construct
  misc_feature 1..1290: note = derived and/or modified CDS sequence (opt4) from HTNV(LongquanAa-08-150)__JQ912697.1__N
  source 1..1290: mol_type = other RNA
atggccaccatggaggagctgcagagagagatcgacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactgggccgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4981 - RNA, 1290 nt, synthetic construct
  misc_feature 1..1290: note = derived and/or modified CDS sequence (opt4) from HTNV(LongquanAa-08-157)__JQ912698.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactgggccgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4982 - RNA, 1290 nt, synthetic construct
  misc_feature 1..1290: note = derived and/or modified CDS sequence (opt4) from HTNV(LongquanAa-08-314)__JQ912709.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatgcaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactgggccgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4983 - RNA, 1290 nt, synthetic construct
  misc_feature 1..1290: note = derived and/or modified CDS sequence (opt4) from HTNV(LongquanAa-08-573)__JQ912714.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactgggccgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgccaccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4984 - RNA, 1290 nt, synthetic construct
  misc_feature 1..1290: note = derived and/or modified CDS sequence (opt4) from HTNV(LongquanAa-09-113)__JQ912716.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcaccagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactgggccgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4985 - RNA, 1290 nt, synthetic construct
  misc_feature 1..1290: note = derived and/or modified CDS sequence (opt4) from HTNV(LongquanAa-09-191)__JQ912719.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccatcaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactgggccgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4986 - RNA, 1290 nt, synthetic construct
  misc_feature 1..1290: note = derived and/or modified CDS sequence (opt4) from HTNV(LongquanAa-09-192)__JQ912720.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatgcagggcaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactgggccgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4987 - RNA, 1290 nt, synthetic construct
  misc_feature 1..1290: note = derived and/or modified CDS sequence (opt4) from HTNV(LongquanAa-10-46)__JQ912754.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccgagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactgggccgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4988 - RNA, 1290 nt, synthetic construct
  misc_feature 1..1290: note = derived and/or modified CDS sequence (opt4) from HTNV(LongquanAa-11-745)__KC344237.1__N
  source 1..1290: mol_type = other RNA
atggccaccatggaggagctgcagaaggagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactgggccgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4989 - RNA, 1290 nt, synthetic construct
  misc_feature 1..1290: note = derived and/or modified CDS sequence (opt4) from HTNV(ROKA14-11)__KU207207.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcgtggccggcatcgccgagctgggcgccttcttcagcatcctgcaggacatgagaaacaccatcatggccagcaagaccgtgggcaccagcgaggagaagatgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4990 - RNA, 1290 nt, synthetic construct
  misc_feature 1..1290: note = derived and/or modified CDS sequence (opt4) from HTNV(US8A14-2)__KU207208.1__N
  source 1..1290: mol_type = other RNA
atggccaccatggaggagctgcagagagagatcaacgcccacgagggccagctggtgatcgccagacagaaggtgagagacgccgagaagcaggacggcaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4991 - RNA, 1290 nt, synthetic construct
  misc_feature 1..1290: note = derived and/or modified CDS sequence (opt4) from HTNV(US8A15-1)__KU207209.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagatcgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4992 - RNA, 1290 nt, synthetic construct
  misc_feature 1..1290: note = derived and/or modified CDS sequence (opt4) from HTNV(YaluRiver13)__HQ611981.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcggccagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccagcatcggcgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtgagctggggcaaggaggccgtggacaacttccacctgggcgacgacatggaccccgagctgagaaccctggcccagagcctgatcgacgtgaaggtgaaggagatccccaaccaggagcccctgaagctgtga

SEQ ID NO: 4993 - RNA, 1290 nt, synthetic construct
  misc_feature 1..1290: note = derived and/or modified CDS sequence (opt4) from HTNV(84FLi)__AY017064.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaactacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4994 - RNA, 1290 nt, synthetic construct
  misc_feature 1..1290: note = derived and/or modified CDS sequence (opt4) from HTNV(Bao14)__AB127998.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4995 - RNA, 1290 nt, synthetic construct
  misc_feature 1..1290: note = derived and/or modified CDS sequence (opt4) from HTNV(Chen4)__AB027101.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgccccctgcaagctgctgcccgacaccgccgccgtgagcctgcacggcggccccgccaccaacagagacaacctgagacagagacaggtggccctgggcaacatggagaccaaggagagcaaggccatcagacagcacgccgagagcgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttcagactgggcgacgacatggaccccgagctgagaaccctggcccagagcctgatcgacgtgaaggtgaaggagatcagcaaccaggagcccctgaagctgtga

SEQ ID NO: 4996 - RNA, 1290 nt, synthetic construct
  misc_feature 1..1290: note = derived and/or modified CDS sequence (opt4) from HTNV(Hu)__AB027111.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagaagcccccccacctgcatgttcatcgccggcatcgacgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacatcaaggtgaaggagatcagcaaccaggagcccctgaagctgtga

SEQ ID NO: 4997 - RNA, 1290 nt, synthetic construct
  misc_feature 1..1290: note = derived and/or modified CDS sequence (opt4) from HTNV(HubeiHu02)__JQ665905.1__N
  source 1..1290: mol_type = other RNA
atggccaccatggaggagctgcagaaggagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggacatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4998 - RNA, 1290 nt, synthetic construct
  misc_feature 1..1290: note = derived and/or modified CDS sequence (opt4) from HTNV(HV004)__JQ083395.1__N
  source 1..1290: mol_type = other RNA
atggccaccatggaggagctgcagaaggagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 4999 - RNA, 1290 nt, synthetic construct
  misc_feature 1..1290: note = derived and/or modified CDS sequence (opt4) from HTNV(Maaji-1)__AF321094.1__N
  source 1..1290: mol_type = other RNA
atggccaccatggaggagctgcagaaggagatcaacgcccacgagggccagctggtgatcgccagacagaaggtgagagacgccgagagacagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcatggccctggccaaggactggagcgagagaatcgagcagtggctgagcgagccctgcaagctgctgcccgacaccagcgccgtgagcctgctgggcggccccgccaccaacaaggactacctgagacagagacaggtggccctgggcaacatggagaccaaggagagcaaggccatcagacagcaggccgaggccagcggctgcagcatgatcgaggacatcgagagccccagcagcatctgggtgttcgccggcgcccccgacagatgcccccccacctgcctgttcatcgccggcatggccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5000 - RNA, 1290 nt, synthetic construct
  misc_feature 1..1290: note = derived and/or modified CDS sequence (opt4) from HTNV(Maaji-2)__AF321095.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgtgagcatccaggccaagatcgacgagctgaagagacagctggccgacagaatcgccaccggcaagaacttcggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagctgatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5001 - RNA, 1290 nt, synthetic construct
  misc_feature 1..1290: note = derived and/or modified CDS sequence (opt4) from HTNV(N8)__DQ658415.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacctgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacgccgccgccgtgagcctgcacggcggccccgccaccaacagagactacctgagacagagacaggtggccctgggcaacatggagaccaaggagagcaaggccatcagacagcacgccgagaccgccggctgcagcatgatcgacgacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5002 - RNA, 1290 nt, synthetic construct
  misc_feature 1..1290: note = derived and/or modified CDS sequence (opt4) from HTNV(Q32)__AB027097.1__N
  source 1..1290: mol_type = other RNA
atggccaccatggaggagctgcagagagagatcaacgcccacgagggccagctggtgatcgccagactgaaggtgagagacgccgagaagccctacgagaaggaccccgacgagctgaacatgagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccagcccggcgacgacatggaccccgagctgagaaccctggcccagagcctgatcgacgtgaaggtgaaggagatcagcaaccaggagcccctgaagctgtga

SEQ ID NO: 5003 - RNA, 1290 nt, synthetic construct
  misc_feature 1..1290: note = derived and/or modified CDS sequence (opt4) from HTNV(SXHu2012B1)__KC844226.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5004 - RNA, 1290 nt, synthetic construct
  misc_feature 1..1290: note = derived and/or modified CDS sequence (opt4) from HTNV(TJJ16)__AY839871.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcctggccgccagcatccaggccaagatcgacgagctgaagagacagctggccgacagaatcgccaccggcaagaacctgggcaaggagagagaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgtacatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5005 - RNA, 1290 nt, synthetic construct
  misc_feature 1..1290: note = derived and/or modified CDS sequence (opt4) from HTNV(WCL)__KM355414.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctggagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5006 - RNA, 1290 nt, synthetic construct
  misc_feature 1..1290: note = derived and/or modified CDS sequence (opt4) from HTNV(YN509)__GU329991.1__N
  source 1..1290: mol_type = other RNA
atggccaccatggaggagctgcagaaggagatcaacgcccacgagggccagctgatcatcgccaagcagaaggtgaaggacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggccaggacagagaccccaccggcgtggagcccggcgaccacctgaaggagagaagcatgctgagctacggcaacatcctggacctgaaccacctggacatcgacgagcccaccggccagaccgccgactggctgagcatcatcgtgtacctgaccagcttcgtggtgcccatcctgctgaaggccctgtacatgctgaccaccagaggcagacagaccgccaaggacaacaagggcaccagaatcagattcaaggacgacagcagcttcgaggacgtgaacggcatcagaaagcccaagcacctgtacgtgagcatgcccaacgcccagagcagcatgaaggccgaggagatcacccccggcagatacagaaccgccgtgtgcggcctgtaccccgcccagatcaaggccagacagatggtgagccccgtgatgagcgtgatcggcttcatggccctggccaaggactggaccgacagaatcgagaactggctgggcgagccctgcaagctgctgcccgacaccagcagcgtgatcctgctgggcggccccgccaccaacagagactacatcagacagagacaggtggccctgggcaacatggagaccaaggaggccaaggccgtgagacagcacgccgagagcgccggctgcagcatgatcgacaacatcgacagccccagcagcatctgggtgttcgccggcgcccccgacagatgcccccccacctgcctgttcgtggccggcctggccgagctgggcgccttcttcagcatcctgcaggacatgagaaacaccatcatggccagcaagaccgtgggcaccagcgaggagaagatgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaacctggcccagagcctgatcgaccagaaggtgaaggagatcagcaaccaggagcccctgaagctgtga

SEQ ID NO: 5007 - RNA, 1290 nt, synthetic construct
  misc_feature 1..1290: note = derived and/or modified CDS sequence (opt4) from HTNV(YU62)__AY748309.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcctggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5008 - RNA, 1290 nt, synthetic construct
  misc_feature 1..1290: note = derived and/or modified CDS sequence (opt4) from HTNV(ZLS6-11)__FJ753396.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacatcaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5009 - RNA, 1290 nt, synthetic construct
  misc_feature 1..1290: note = derived and/or modified CDS sequence (opt4) from HTNV__AB027523.1__N
  source 1..1290: mol_type = other RNA
atggccaccatggaggagctgcagaaggagatcaacgcccacgagggccagctgatcatcgccaagcagaaggtgaaggacgccgagaagcagtacgagaaggaccccgacgagctgaacaagagagccctgaccgacagagagggcgtgagcgccagcatccaggccaagatcgacgagctgaagagacagctggccgacagaatcgccaccggcaagaacctgggccaggacagagaccccaccggcgtggagcccggcgaccacctgaaggagagaagcatgctgagctacggcaacatcctggacctgaaccacctggacatcgacgagcccaccggccagaccgccgactggctgagcatcatcgtgtacctgaccagcttcgtggtgcccatcctgctgaaggccctgtacatgctgaccaccagaggcagacagaccgccaaggacaacaagggcaccagaatcagattcaaggacgacagcagcttcgaggacgtgaacggcatcagaaagcccaagcacctgtacgtgagcatgcccaacgcccagagcagcatgaaggccgaggagatcacccccggcggctacagaaccgccgtgtgcggcctgttccccgcccagatcaaggccagacagatggtgagccccgtgatgagcgtgatcggcttcatggccctggccaaggactggaccgacagaatcgagagctggctgggcgagccctgcaagctgctgcccgacaccagcgccgtgagcctgctgggcggccccgccaccaacagagactacatcagacagagacaggtggccctgggcaacatggagaccaaggaggccaaggccgtgagacagcacgccgagagcgccggctgcagcatgatcgacaacatcgacagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagatgagaaagaagagcagcttctaccagagctacctgagaagaacccagagcatgggcatccagctggaccagagaatcatcgtgctgttcatggtggcctggggcaaggaggccgccgacaacttccagcacggcgacgacatggaccccgagctgagaaccctggcccagagcctgatcgaccagaaggtgaaggagatcagcaaccaggagcccctgaagctgtga

SEQ ID NO: 5010 - RNA, 1293 nt, synthetic construct
  misc_feature 1..1293: note = derived and/or modified CDS sequence (opt4) from HTNV__D25530.1__N
  source 1..1293: mol_type = other RNA
atgatggccaccatggaggagctgcagagagagatcaacgcccacgagggccagctggtgatcgccagacagaaggtgagagacgccgagaagcagtacgagaaggaccccgacgagctgaacaagagagccctgaccaacagagagggcgtggccgtgagcatccaggccaagatcgacgagctgaagatgcagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcatcgtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgatcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5011 - RNA, 1290 nt, synthetic construct
  misc_feature 1..1290: note = derived and/or modified CDS sequence (opt4) from HTNV__M14626.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcatcgtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgatcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctgggccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5012 - RNA, 1290 nt, synthetic construct
  misc_feature 1..1290: note = derived and/or modified CDS sequence (opt4) from HTNV__X95077.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccaccctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccaccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5013 - RNA, 1290 nt, synthetic construct
  misc_feature 1..1290: note = derived and/or modified CDS sequence (opt4) from HTNV(CGAa1011)__EF990913.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctggacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgggcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcttcagcgtgctgcaggacatgagaaacaccatcatggccagcaagaccgtgggcaccagcgaggagaagctgagaaagaagagcagcttctaccagagctacctgggcagaacccagagcatgggcatccagctggaccagagaatcatcgtgctgttcatggtggcctggggcaaggaggccgtggacaacttccacctgggcgacgacgtggaccccgagctgagaaccctggcccagagcctgatcgacgtgaaggtgaaggagatcagcgaccaggagcccctgaagctgtga

SEQ ID NO: 5014 - RNA, 1290 nt, synthetic construct
  misc_feature 1..1290: note = derived and/or modified CDS sequence (opt4) from HTNV(CGAa1015)__EF990912.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctggacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggctacctggccctggccaaggactggagcgacagaatcgagcagtggctgggcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcatcagcgtgctgcaggacatgagaaacaccatcatggccagcaagaccgtgggcaccagcgaggagaagctgagaaagaagagcagcttctaccagagctacctgggcagaacccagagcatgggcatccagctggaccagagaatcatcgtgctgttcatggtggcctggggcaaggaggccgtggacaacttccacctgggcgacgacgtggaccccgagctgagaaccctggcccagagcctgatcgacgtgaaggtgaaggagatcagcgaccaggagcccctgaagctgtga

SEQ ID NO: 5015 - RNA, 1290 nt, synthetic construct
  misc_feature 1..1290: note = derived and/or modified CDS sequence (opt4) from HTNV(CGAa2)__EU092219.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccaaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagcccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5016 - RNA, 1290 nt, synthetic construct
  misc_feature 1..1290: note = derived and/or modified CDS sequence (opt4) from HTNV(CGAa31MP7)__EF990911.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5017 - RNA, 1290 nt, synthetic construct
  misc_feature 1..1290: note = derived and/or modified CDS sequence (opt4) from HTNV(CGAa31P9)__EF990910.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccgagatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5018 - RNA, 1290 nt, synthetic construct
  misc_feature 1..1290: note = derived and/or modified CDS sequence (opt4) from HTNV(CGAa4MP9)__EF990915.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgggcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgagaccgccggctgcagcatgatcgaggacatcgagagccccagcagcatctgggtgttcgccggcgcccccgacagatgcccccccacctgcctgttcatcgccggcatcgccgagctgggcgccttcttcagcgtgctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5019 - RNA, 1290 nt, synthetic construct
  misc_feature 1..1290: note = derived and/or modified CDS sequence (opt4) from HTNV(CGAa75)__EU092220.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcagcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgaacgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5020 - RNA, 1290 nt, synthetic construct
  misc_feature 1..1290: note = derived and/or modified CDS sequence (opt4) from HTNV(CGHu1)__EU092218.1__N
  source 1..1290: mol_type = other RNA
atggccaccatggaggagctgcagagagagatcaacgcccacgagggccagctggtgatcgccagacagaaggtgagagacgccgagaagcagtacgagaaggacagcgacgagctgaacaagagaaccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcctggtggtgcccatcctgctgaaggccctgtacatgctgaccaccaagggcagacagaccaccaaggacaacaagggcaccagaatcagattcaaggacgacagcagcttcgaggacgtgaacggcatcagaaagcccaagcacctgtacgtgagcctgctgaacgcccagagcagcatgaaggccgaggagatcacccccggcagatacagaaccgccatctgcggcccctaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgagcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5021 - RNA, 1290 nt, synthetic construct
  misc_feature 1..1290: note = derived and/or modified CDS sequence (opt4) from HTNV(CGHu2)__EU363813.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcctggtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcagccaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5022 - RNA, 1290 nt, synthetic construct
  misc_feature 1..1290: note = derived and/or modified CDS sequence (opt4) from HTNV(CGHu3612)__EF990909.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcctggccgccagcatccaggccaagatcgacgagctgaagagacagctggccgacagagtggccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgagagagatcagcaaccaggagcccctgaagctgtga

SEQ ID NO: 5023 - RNA, 1290 nt, synthetic construct
  misc_feature 1..1290: note = derived and/or modified CDS sequence (opt4) from HTNV(CGRn15)__EU363810.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgaccctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5024 - RNA, 1290 nt, synthetic construct
  misc_feature 1..1290: note = derived and/or modified CDS sequence (opt4) from HTNV(CGRn2616)__EU363811.1__N
  source 1..1290: mol_type = other RNA
atggccaccatggaggagctgcagagagagatcaacgcccacgagggccagctggtgatcgccagacagaaggtgagagacgccggcaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcggcagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtggaggtgaaggagatcagcaaccaggagcccctgaagctgtga

SEQ ID NO: 5025 - RNA, 1290 nt, synthetic construct
  misc_feature 1..1290: note = derived and/or modified CDS sequence (opt4) from HTNV(CGRn53)__EF990907.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5026 - RNA, 1290 nt, synthetic construct
  misc_feature 1..1290: note = derived and/or modified CDS sequence (opt4) from HTNV(CGRn5310)__EF990906.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagcccaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5027 - RNA, 1290 nt, synthetic construct
  misc_feature 1..1290: note = derived and/or modified CDS sequence (opt4) from HTNV(CGRn93MP8)__EF990905.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgcccccatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcagcagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5028 - RNA, 1290 nt, synthetic construct
  misc_feature 1..1290: note = derived and/or modified CDS sequence (opt4) from HTNV(CGRn93P8)__EF990904.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcatcagcatcctgcaggacatgagaaacaccatcatggccagcaagaccgtgggcaccagcgaggagaagctgagaaacaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5029 - RNA, 1290 nt, synthetic construct
  misc_feature 1..1290: note = derived and/or modified CDS sequence (opt4) from HTNV(CGRni1)__EU363812.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcagagagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacatcaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatggtggaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgctgatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5030 - RNA, 1290 nt, synthetic construct
  misc_feature 1..1290: note = derived and/or modified CDS sequence (opt4) from HTNV(CJAp93)__EF208929.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgggcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtgaacaacttccacctgggcgacgacatggaccccgagctgagaaccctggcccagagcctgatcgacgtgaaggtgaaggagatcagcaaccaggagcccctgaagctgtga

SEQ ID NO: 5031 - RNA, 1290 nt, synthetic construct
  misc_feature 1..1290: note = derived and/or modified CDS sequence (opt4) from HTNV(Aa14_207)__KX687234.1__N
  source 1..1290: mol_type = other RNA
atggccaccatggaggagctgcagagagagatcaacgcccacgagggccagctggtgatcgccagacagaaggtgagagacgccgagaagcagtacggcaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcgtggccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5032 - RNA, 1290 nt, synthetic construct
  misc_feature 1..1290: note = derived and/or modified CDS sequence (opt4) from HTNV(Aa14_234)__KX687235.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgggcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5033 - RNA, 1290 nt, synthetic construct
  misc_feature 1..1290: note = derived and/or modified CDS sequence (opt4) from HTNV(Aa14_239)__KX687236.1__N
  source 1..1290: mol_type = other RNA
atggccaccatggaggagctgcagagagagatcaacgcccacgagggccagctggtgatcgccagacagaaggtgagagacgccgagaagcaggacggcaaggaccccgacgagctgaacaagagagccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgggcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5034 - RNA, 1290 nt, synthetic construct
  misc_feature 1..1290: note = derived and/or modified CDS sequence (opt4) from HTNV(AY133/2011)__KY807166.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacatcggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgagcggcatcagaaagcccaagcacctgtacctgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagaccgccggctgcagcatgatcgacgacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5035 - RNA, 1290 nt, synthetic construct
  misc_feature 1..1290: note = derived and/or modified CDS sequence (opt4) from HTNV(GAN13/2011)__KY807168.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacctgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagaccgccggctgcagcatgatcgacgacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5036 - RNA, 1290 nt, synthetic construct
  misc_feature 1..1290: note = derived and/or modified CDS sequence (opt4) from HTNV(GAN19/2011)__KY807172.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacctgagcctgcccaacgcccagagcagcatgaaggccgaggagatcacccccggcagatacagaaccgccatctgcggcctgtaccccgcccagatcaaggccagacagatgaccagccccgtgatgagcgtgatcggcttcctggccctggccaaggactggagcgacagaatcgagcagtggctgagcgagccctgcaagctgctgcccgacaccgccgccgtgagcctgcacggcggccccgccaccagcagagactacctgagacagagacaggtggccctgggcaacatggagaccaaggagagcaaggccatcagacagcacgccgagaccgccggctgcagcatgatcgacgacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcctgtaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5037 - RNA, 1290 nt, synthetic construct
  misc_feature 1..1290: note = derived and/or modified CDS sequence (opt4) from HTNV(LR1)__AF288294.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagagccctgaccaacagagagggcgtggccgtgagcatccaggccaagatcgacgagctgaagatgcagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcatcgtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccgacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgatcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5038 - RNA, 1290 nt, synthetic construct
  misc_feature 1..1290: note = derived and/or modified CDS sequence (opt4) from HTNV(RG9)__AF288296.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcaccgccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5039 - RNA, 1290 nt, synthetic construct
  misc_feature 1..1290: note = derived and/or modified CDS sequence (opt4) from HTNV(S85-46)__AF288659.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagcgccctgaccaacagagagggcgtggccgtgagcatccaggccaagatcgacgagctgaagatgcagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcatcgtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgatcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccggcagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5040 - RNA, 1290 nt, synthetic construct
  misc_feature 1..1290: note = derived and/or modified CDS sequence (opt4) from HTNV(SN7)__AF288657.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaagaccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5041 - RNA, 1290 nt, synthetic construct
  misc_feature 1..1290: note = derived and/or modified CDS sequence (opt4) from HTNV(84FLi)__AF366568.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgccagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccatctgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgcacggcggccccgccaccaacagagactacctgagacagagacaggtggccctgggcaacatggagaccaaggagagcaaggccatcagacagcacgccgagagcgccggctgcagcatgatcgaggacatcgagagccccagcagcatctgggtgttcgccggcgcccccaacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5042 - RNA, 1290 nt, synthetic construct
  misc_feature 1..1290: note = derived and/or modified CDS sequence (opt4) from HTNV(KHF,clone:4)__LC209206.1__N
  source 1..1290: mol_type = other RNA
atggccaccatggaggagctgcagagagagatcaacgcccacgagggccagctggtgatcgccagacagaaggtgagagacgccgagaagcagtacgagaaggaccccgacgagctgaacaagagaaccctgaccgacagagagggcgtggccgtgagcatccaggccaagatcgacgagctgaagagacagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgagcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtga

SEQ ID NO: 5043 - RNA, 1287 nt, synthetic construct
  misc_feature 1..1287: note = derived and/or modified CDS sequence (opt4) from LANV(510B)__AF005727.1__N
  source 1..1287: mol_type = other RNA
atgagcaacctgcaggaggtgcaggagggcatcaccctgcacgagcagcagctggtggccgccagacagaagctgaaggacgccgagaaggccgtggaggtggaccccgacgacgtgaacaagagcaccctgcagagcagaagagccgccgtgagcgccctggagaacaagctggccgagctgaagagacagctggccgacctggtggccgcccagaagctggccgccaagcccgtggaccccaccggcctggagcccgacgaccacctgaaggagaagagcgccctgagatacggcaacgtgctggacgtgaacgccatcgacctggaggagcccagcggccagaccgccgactggaaggccatcggcgcctacatcctgggcttcgtgatccccatcatcctgaaggccctgtacatgctgagcaccagaggcagacagaccgtgaaggagaacaagggcaccagaatcagattcaaggacgacagcagcttcgaggaggtgaacggcatcagaaagcccaagcacctgtacgtgagcatgcccaccgcccagagcaccatgaaggccgacgagatcacccccggcagattcagaaccatcgcctgcggcctgttccccgcccagatcaaggccagaaacatcatcagccccgtgatgggcgtgatcggcttcggccacttcgtgaaggactggatggagagaatcgacaacttcctgggcgaggactgccccttcctgcccaaggccagagtgcagagcgaggccttcatgagcaccaacagagcctacttcctgaacagacagagacaggtggacgagagcagaatccaggacatcgtggacctgatccaggccgccgaggccagcagcgccaccctgttcaacgacatcgccaccccccacagcgcctgggtgttcgcctgcgcccccgacagatgcccccccaccgccctgtacgtggccggcgtgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagaccctgatcgacgccaaggtgaaggagatcagcaaccaggagcccctgaagctgtga

SEQ ID NO: 5044 - RNA, 1287 nt, synthetic construct
  misc_feature 1..1287: note = derived and/or modified CDS sequence (opt4) from LANV(12234)__ALD61435.1__N
  source 1..1287: mol_type = other RNA
atgagcaccctgcaggaggtgcaggagggcatcaccctgcacgagcagcagctggtggccgccagacagaagctgaaggacgccgagaaggccgtggaggtggaccccgacgacgtgaacaagagcaccctgcagagcagaagagccgccgtgagcgccctggagaacaagctggccgagctgaagagacagctggccgacctggtggccgcccagaagctggccgccaagcccgtggaccccaccggcctggagcccgacgaccacctgaaggagaagagcgccctgagatacggcaacgtgctggacgtgaacgccatcgacctggaggagcccagcggccagaccgccgactggaaggccatcggcgcctacatcctgggcttcgtgatccccatcatcctgaaggccctgtacatgctgagcaccagaggcagacagaccgtgaaggagaacaagggcaccagaatcagattcaaggacgacagcagcttcgaggaggtgaacggcatcagaaagcccaagcagctgtacgtgagcatgcccaccgcccagagcaccatgaaggccgacgagatcacccccggcagattcagaaccatcgcctgcggcctgttccccgcccagatcaaggccagaaacatcatcagccccgtgatgggcgtgatcggcttcagccacttcgtgaaggactggatggagagaatcgacgacttcctggccgccgactgccccttcctgcccaagcccagagtgcagagcgaggccttcatggccaccaacagagcctacttcatcaacagacagagacagatcgacgagagcagaatgcccgacatcatggacctgatccaggccgccgaggccggcagcgccaccctgttcaacgacatcgccaccccccacagcgcctgggtgttcgcctgcgcccccgacagatgcccccccaccgccctgtacgtggccggcgtgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagaccctgatcgacaccaaggtgaaggagatcagcaaccaggagcccctgaagctgtga

SEQ ID NO: 5045 - RNA, 1272 nt, synthetic construct
  misc_feature 1..1272: note = derived and/or modified CDS sequence (opt4) from LQUV(Longquan-Rs-32)__JX465422.1__N
  source 1..1272: mol_type = other RNA
atggccaccggcagagacctgcaggacgagctggagcagatcgagcaggagatcacccaggccaaggccaagtacgagaagcagaaggccgccatcggcgaggagcccgacaccatcgagctgaaggtgctgcagcagagagaggagaccatccacatgctggaggagaagagaaaggagctgctgcagagaatcgcccagcagatgaagagccccagacagcccgtgaagggcagagacctggacgaggacgagcacctgagcgagagaagcaccctgagatacggcaacgtgatcgacctggaggagctggacatcgacgagcccgccggcggcagcgccgactggctggccatcggcatctacatcttcagcttccccgtgcagctgctgctgaagaccctgtacatcctgaccaccagaggcagacagaccatcaaggagaacaagggcaacagactgagattcaaggacagcagcagcaccatggacgtgaacggcgtgaagacccccagacacctgtacatcagcctgcccaccgcccagagcagcatgaagaccgaggagatcacccccggcagatacagaaccgtggcctgcggcatcctgagcggcgagatgagagccagaaagctggtgagccccgtgatgggcgtgatcggcttcaactacctggccgagaagtggggcgagtacatcgacgccttcctgatgaagcagagcccccacctgcccgtgagcaccggcagccccgagagcgccaccaacttcgcctacctgatccagagacaggacgtgctgaacaagagcaagaccgtggagtacctggagctgtgggagcaggccgagaaggccggcagacacctggtggacagaatcgagagccccctgaccccctggctgttcgccggcagccccgacagatgcccccccaccagcctgtacgtggccggcatcgccgagctgggcgccttcttcagcatcctgcaggacatcagaaacgccatcatggccagcaagctggtgggcaccgccgaggagaagctgaagagaaagagcagcttctaccagagctacctgagaagaacccagagcatgggcgtgcagctggaccagagaatcatcatcctgtacatgatggagtggggcaagatgatggtggaccacttccacctgggcgacgacatggacagcgagctgagaaaggcctgccagagcctgatcgacgagaaggtggcccaggtgagcaaccaggaggccctgaagctgtga

SEQ ID NO: 5046 - RNA, 1272 nt, synthetic construct
  misc_feature 1..1272: note = derived and/or modified CDS sequence (opt4) from LQUV(Longquan-Ra-14)__JX465414.1__N
  source 1..1272: mol_type = other RNA
atggccaccggcagagacctgcaggacgagctggagcagatcgagcaggagatcacccaggccaaggccaagtacgagaagcagaaggccgccatcggcgaggagcacgacaccatcgagctgaaggtgctgcagcagagagaggagaccatccacatgctggaggagaagagaaaggagctgctgcagagaatcgcccagcagatgaagagccccagacagcccgtgaagggcagagacctggacgaggacgagcacctgagcgagagaagcaccctgagatacggcaacgtgatcgacctggaggagctggacatcgacgagcccgccggcggcagcgccgactggctggccatcggcatctacatcttcagcttccccgtgcagctgctgctgaagaccctgtacatcctgaccaccagaggcagacagaccatcaaggagaacaagggcaacagactgagattcaaggacagcagcagcaccatggacgtgaacggcgtgaagacccccagacacctgtacatcagcctgcccaccgcccagagcagcatgaagaccgaggagatcacccccggcagatacagaaccgtggcctgcggcatcctgagcggcgagatgagagccagaaagctggtgagccccgtgatgggcgtgatcggcttcaactacctggccgagaagtggggcgagtacatcgacgccttcctgatgaagcagagcccccacctgcccgtgagcaccggcagccccgagagcgccaccaacttcgcctacctgatccagagacaggacgtgctgaacaagagcaagaccgtggagtacctggagctgtgggagcaggccgagaaggccggcagacacctggtggacagaatcgagagccccctgaccccctggctgttcgccggcagccccgacagatgcccccccaccagcctgtacgtggccggcatcgccgagctgggcgccttcttcagcatcctgcaggacatcagaaacgccatcatggccagcaagctggtgggcaccgccgaggagaagctgaagagaaagagcagcttctaccagagctacctgagaagaacccagagcatgggcgtgcagctggaccagagaatcatcatcctgtacatgatggagtggggcaagatgatggtggaccacttccacctgggcgacgacatggacagcgagctgagaaaggcctgccagagcctgatcgacgagaaggtggcccaggtgagcaaccaggaggccctgaagctgtga

SEQ ID NO: 5047 - RNA, 1272 nt, synthetic construct
  misc_feature 1..1272: note = derived and/or modified CDS sequence (opt4) from LQUV(Longquan-Ra-25)__JX465415.1__N
  source 1..1272: mol_type = other RNA
atggccaccggcagagacctgcaggacgagctggagcagatcgagcaggagatcacccaggccaaggccaagtacgagaagcagaaggccgccatcggcgaggagcccgacaccatcgagctgaaggtgctgcagcagagagaggagaccatccacatgctggaggagaagagaaaggagctgctgcagagaatcgcccagcagatgaagagccccaagcagcccgtgaagggcagagacctggacgaggacgagcacctgagcgagagaagcaccctgagatacggcaacgtgatcgacctggaggagctggacatcgacgagcccgccggcggcagcgccgactggctggccatcggcatctacatcttcagcttccccgtgcagctgctgctgaagaccctgtacatcctgaccaccagaggcagacagaccatcaaggagaacaagggcaacagactgagattcaaggacagcagcagcaccatggacgtgaacggcgtgaagacccccagacacctgtacatcagcctgcccaccgcccagagcagcatgaagaccgaggagatcacccccggcagatacagaaccgtggcctgcggcatcctgagcggcgagatgagagccagaaagctggtgagccccgtgatgggcgtgatcggcttcaactacctggccgagaagtggggcgagtacatcgacgccttcctgatgaagcagagcccccacctgcccgtgagcaccggcagccccgagagcgccaccaacttcgcctacctgatccagagacaggacgtgctgaacaagagcaagaccgtggagtacctggagctgtgggagcaggccgagaaggccggcagacacctggtggacagaatcgagagccccctgaccccctggctgttcgccggcagccccgacagatgcccccccaccagcctgtacgtggccggcatcgccgagctgggcgccttcttcagcatcctgcaggacatcagaaacgccatcatggccagcaagctggtgggcaccgccgaggagaagctgaagagaaagagcagcttctaccagagctacctgagaagaacccagagcatgggcatccagctggaccagagaatcatcatcctgtacatgatggagtggggcaagatgatggtggaccacttccacctgggcgacgacatggacagcgagctgagaaaggcctgccagagcctgatcgacgagaaggtggcccaggtgagcaaccaggaggccctgaagctgtga

SEQ ID NO: 5048 - RNA, 1287 nt, synthetic construct
  misc_feature 1..1287: note = derived and/or modified CDS sequence (opt4) from NYV(RI-1)__U09488.1__N
  source 1..1287: mol_type = other RNA
atgagcaccctgaaggaggtgcaggacaacatcaccctgcacgagcagcagctggtgaccgccagacagaagctgaaggacgccgagaaggccgtggaggtggaccccgacgacgtgaacaagagcaccctgcagggcagaagagccgccgtgagcgccctggagaccaagctgggcgagctgaagagacagctggccgacctgatcgccgcccagaagctggccagcaagcccatcgaccccaccggcatcgagcccgacgaccacctgaaggagaagagcagcctgagatacggcaacgtgctggacgtgaacagcatcgacctggaggagcccagcggccagaccgccgactggaaggccatcggcatgtacatcctgagcttcgccatccccatcatcctgaaggccctgtacatgctgagcaccagaggcagacagaccgtgaaggagaacaagggcaccagaatcagattcaaggacgacagcagctacgaggaggtgaacggcatcagaaagcccagacacctgtacgtgagcatgcccaccgcccagagcaccatgaaggccgacgagatcacccccggcagattcagaaccatcgcctgcggcctgttccccgcccaggtgaaggccagaaacatcatcagccccgtgatgggcgtgatcggcttcaacttcttcgtgaaggactggatggacagaatcgacgacttcctggccgagagatgccccttcctgcccgagcccagagaccccaaggacgccgccctgggcaccaacagagcctacttcatcaccagacaggcccaggtggacgagagcaaggtggtggacatcgaggagctgatcgtggacgccagagccgagagcgccaccctgttcgccgacatcgccaccccccacagcgtgtgggtgttcgcctgcgcccccgacagatgcccccccaccgccctgtacgtggccggcatgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgatccactggggcaaggaggccgtgaaccacttccacctgggcgacgacatggaccccgagctgagagagctggcccaggccctggtggacgccaaggtgaaggagatcagcaaccaggagcccctgaagctgtga

SEQ ID NO: 5049 - RNA, 1302 nt, synthetic construct
  misc_feature 1..1302: note = derived and/or modified CDS sequence (opt4) from PUUV(K27)__L08804.1__N
  source 1..1302: mol_type = other RNA
atgagcgacctgaccgacatccaggaggagatcaccagacacgagcagcagctggtggtggccagacagaagctgaaggacgccgagagagccgtggaggtgtaccccgacgacgtgatcaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagaagatcagagagttcatggagaaggagtgccccttcatcaagcccgaggtgaagcccggcacccccgcccaggaggtggagttcctgaagagaaacagagtgtacttcatgaccagacaggacgtgctggacaagaaccacgtggccgacatcgacaagctgatcgactacgccgccagcggcgaccccaccagccccgacgacatcaagagccccaacgccccctgggtgttcgcctgcgcccccgacagaagcccccccacctgcatctacgtggccggcatggccgagctgggcgccttcttcagcatcctgcaggacatgagaaacaccatcatggccagcaagaccgtgggcaccgccgaggagaagctgaagagaaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccagagcctgatcgaccagaaggtgaaggagatcagcaaccaggagcccctgaagatctga

SEQ ID NO: 5050 - RNA, 1302 nt, synthetic construct
  misc_feature 1..1302: note = derived and/or modified CDS sequence (opt4) from PUUV(KS13/855)__KX815394.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgaggtgaagcccggcacccccgcccaggaggtggagttcctgaagaagaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5051 - RNA, 1302 nt, synthetic construct
  misc_feature 1..1302: note = derived and/or modified CDS sequence (opt4) from PUUV(KS14/118)__KX815395.1__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaagaactggcccgagagaatcaaggagttcatggagaaggagtgccccttcatcaagcccgaggtgaagcccggcacccccgcccaggaggtggagttcctgaagagaaacaaggtgtacttcatgaacagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5052 - RNA, 1302 nt, synthetic construct
  misc_feature 1..1302: note = derived and/or modified CDS sequence (opt4) from PUUV(LT15/201)__KX757841.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccatcgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgaggtgaagcccggcacccccgcccaggaggtggagttcctgaagaagaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5053 - RNA, 1302 nt, synthetic construct
  misc_feature 1..1302: note = derived and/or modified CDS sequence (opt4) from PUUV(PUU/Ernstbrunn/Cg641/1995)__AJ888752.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcaagagacccaagcacctgtacgtgagcatgcccaccgcccagagcaccatgaaggccgagaagctgacccccggcagattcagaaccatcgtgtgcggcctgttccccacccagatccaggtgagaaacatcatgagccccgtgatgggcgtgatcggcttcagcttcttcgtgaaggactggagcgagagagtgagagacttcatggagaaggagtgccccttcatcaagcccgagatcaagcccggcacccccccccaggaggccgagttcctgaagagaaacaaggtgtacttcatgcagagacaggacgtgctggacaagaaccacgtggccgacatcgacaagctgatcgactacgccgccagcggcgaccccaccagccccgacaacctggagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5054 - RNA, 1302 nt, synthetic construct
  misc_feature 1..1302: note = derived and/or modified CDS sequence (opt4) from PUUV(PUU/Klippitztoerl/Cg9/1995)__AJ888751.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccggcggccagaccgccgactggtacaccatcggcgtgtacgtgatcggcttcaccctgcccatcatcctgaaggccctgtacatgttcagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggagcgagagagtgagagacttcatggagaaggagtgccccttcatcaagcccgagatcaagcccggcacccccccccaggaggccgagttcctgaagagaaacaaggtgtacttcatgcagagacaggacgtgctggacaagaaccacgtggccgacatcgacaagctgatcgactacgccgccagcggcgaccccaccagccccgacaacctggagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5055 - RNA, 1302 nt, synthetic construct
  misc_feature 1..1302: note = derived and/or modified CDS sequence (opt4) from PUUV(Balkan-1)__AJ314600.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggagcgagagagtgagagagttcatggagaaggagtgccccttcatcaagcccgagatcaagcccggcacccccccccaggaggccgagttcctgaagagaaacaaggtgtacttcatgcagagacaggacgtgctggacaagaaccacgtggccgacatcgacaagctgctggactacgccgccagcggcgaccccaccagccacgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5056 - RNA, 1302 nt, synthetic construct
  misc_feature 1..1302: note = derived and/or modified CDS sequence (opt4) from PUUV(Balkan-2)__AJ314601.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgttcggcctgttccccacccagatccaggtgagaaacatcatgagccccgtgatgggcgtgatcggcttcagcttcttcgtgaaggactggagcgagagagtgagagagttcatggagaaggagtgccccttcatcaagcccgagatcaagcccggcgcccccccccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5057 - RNA, 1302 nt, synthetic construct
  misc_feature 1..1302: note = derived and/or modified CDS sequence (opt4) from PUUV(Baltic/205Cg/00)__AJ314599.1__N
  source 1..1302: mol_type = other RNA
atgagcgacctggccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcaaggagttcatggagaaggagtgccccttcatcaagcccgaggtgaagcccggcacccccacccaggaggtggagttcctgaagagaaacaaggtgtacttcatgaacagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaagcaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5058 - RNA, 1302 nt, synthetic construct
  misc_feature 1..1302: note = derived and/or modified CDS sequence (opt4) from PUUV(Baltic/49Cg/00)__AJ314598.1__N
  source 1..1302: mol_type = other RNA
atgagcgacctggccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcaaggagttcatggagaaggagtgccccttcatcaagcccgaggtgaagcccggcacccccgcccaggaggtggagttcctgaagagaaacaaggtgtacttcatgaacagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5059 - RNA, 1302 nt, synthetic construct
  misc_feature 1..1302: note = derived and/or modified CDS sequence (opt4) from PUUV(Pallasjarvi/63Cg/98)__AJ314597.1__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggagcgagagaatcagagagttcatggagaaggagtgccccttcatcaagcccgaggtgaagcccggcacccccgcccaggaggtggagatgctgaagagaaacaagatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5060 - RNA, 1302 nt, synthetic construct
  misc_feature 1..1302: note = derived and/or modified CDS sequence (opt4) from PUUV(Sotkamo 2009)__HE801633.1__N
  source 1..1302: mol_type = other RNA
atgagcgacctgaccgacatccaggaggacatcaccagacacgagcagcagctgatcgtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggagcgagagaatcagagagttcatggagaaggagtgccccttcatcaagcccgaggtgaagcccggcacccccgcccaggagatcgagatgctgaagagaaacaagatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5061 - RNA, 1302 nt, synthetic construct
  misc_feature 1..1302: note = derived and/or modified CDS sequence (opt4) from PUUV(CG 13891)__U22423.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagagcatggagaaggagtgccccttcctgaagcccgacgtgaagcccggcacccccgcccaggagaccgagttcctgaagagaaacaagatctacttcatgcagagacaggaggtgctggacaagaaccacgtggccgagatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5062 - RNA, 1302 nt, synthetic construct
  misc_feature 1..1302: note = derived and/or modified CDS sequence (opt4) from PUUV(CG1820)__M32750.1__N
  source 1..1302: mol_type = other RNA
atgagcgacctgaccgacatccaggaggagatcaccagacacgagcagcagctggtggtggccagacagaagctgaaggacgccgagagagccgtggaggtggaccccgacgacgtgaacaagagcaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagaagatcagagagttcatggagaaggagtgccccttcatcaagcccgaggtgaagcccggcacccccgcccaggaggtggagttcctgaagagaaacagagtgtacttcatgaccagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcagagagatggtggaccacttccacctgggcgacgacatggaccccgagctgagaggcctggcccagagcctgatcgaccagaaggtgaaggagatcagcaaccaggagcccctgaagatctga

SEQ ID NO: 5063 - RNA, 1302 nt, synthetic construct
  misc_feature 1..1302: note = derived and/or modified CDS sequence (opt4) from PUUV(Bussjo_95-1)__AM746297.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgacagaatcagagagttcatggagaaggagtgccccttcatcaagcccgaggtgaagcccggcacccccacccaggagatcgagttcctgaagaagaacaaggtgtacttcatggacagacagaacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggaccccctgaagatctga

SEQ ID NO: 5064 - RNA, 1302 nt, synthetic construct
  misc_feature 1..1302: note = derived and/or modified CDS sequence (opt4) from PUUV(CG144)__AF367064.1__N
  source 1..1302: mol_type = other RNA
atgagcgacctgaccgacatccaggaggacatcaccagacacgagcagcagctggtggccgccagacagaagctgaaggacgccgagagagccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcatctacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgaggtgaagcccggcacccccgcccaggagatcgagatgctgaagaagaacaagatctacttcatgcacagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5065 - RNA, 1302 nt, synthetic construct
  misc_feature 1..1302: note = derived and/or modified CDS sequence (opt4) from PUUV(CG168)__AF367065.1__N
  source 1..1302: mol_type = other RNA
atgagcgacctgaccgacatccaggaggacatcaccagacacgagcagcagctggtggccgccagacagaagctgaaggacgccgagagagccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgaggtgaagcccggcatccccgcccaggagatcgagatgctgaagaagaacaagatctacttcatgcacagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5066 - RNA, 1302 nt, synthetic construct
  misc_feature 1..1302: note = derived and/or modified CDS sequence (opt4) from PUUV(CG17/Baskiria-2001)__AF442613.1__N
  source 1..1302: mol_type = other RNA
atgagcgacctggccgacatccaggaggagatcaccagacacgagcagcagctggtggccgccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagaagatcagagagttcatggagaaggagtgccccttcatcaagcccgaggtgaagcccggcacccccgcccaggaggtggagttcctgaagagaaacagagtgtacttcatgaccagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccagagcctgatcgaccagaaggtgaaggagatcagcaaccaggagcccctgaagatctga

SEQ ID NO: 5067 - RNA, 1302 nt, synthetic construct
  misc_feature 1..1302: note = derived and/or modified CDS sequence (opt4) from PUUV(CG215)__AF367066.1__N
  source 1..1302: mol_type = other RNA
atgagcgacctgaccgacatccaggaggacatcaccagacacgagcagcagctggtggccgccagacagaagctgaaggacgccgagagagccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgaggtgaagcccggcacccccgcccaggagatcgagatgctgaagaagaacaagatctacttcatgcacagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccagaccctgatcgaccagaaggtgaaggagatcagcaaccaggagcccctgaagatctga

SEQ ID NO: 5068 - RNA, 1302 nt, synthetic construct
  misc_feature 1..1302: note = derived and/or modified CDS sequence (opt4) from PUUV(CG315)__AF367068.1__N
  source 1..1302: mol_type = other RNA
atgagcgacctgaccgacatccaggaggacatcaccagacacgagcagcagctggtggccgccagacagaagctgaaggacgccgagagagccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatgaagcccgaggtgaagcccggcacccccgcccaggagatcgagatgctgaagaagaacaagatctacttcatgcacagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5069 - RNA, 1302 nt, synthetic construct
  misc_feature 1..1302: note = derived and/or modified CDS sequence (opt4) from PUUV(CRF161)__AF367069.1__N
  source 1..1302: mol_type = other RNA
atgagcgacctgaccgacatccaggaggacatcaccagacacgagcagcagctggtggccgccagacagaagctgaaggacgccgagagagccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgaggtgaagcccggcacccccgcccaggagatcgagatgctgaagaagaacaagatctacttcatgcacagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5070 - RNA, 1302 nt, synthetic construct
  misc_feature 1..1302: note = derived and/or modified CDS sequence (opt4) from PUUV(CRF308)__AF367070.1__N
  source 1..1302: mol_type = other RNA
atgagcgacctgaccgacatccaggaggacatcaccagacacgagcagcagctggtggccgccagacagaagctgaaggacgccgagagagccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgaggtgaagcccggcacccccgcccaggagatcgagatgctgaagaagaacaagatctacttcatgcacagacaggacgtgctggacaagaaccacgtggccgacatggacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5071 - RNA, 1302 nt, synthetic construct
  misc_feature 1..1302: note = derived and/or modified CDS sequence (opt4) from PUUV(CRF366)__AF367071.1__N
  source 1..1302: mol_type = other RNA
atgaccgacctgaccgacatccaggaggacatcaccagacacgagcagcagctggtggccgccagacagaagctgaaggacgccgagagagccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcatctacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgaggtgaagcccggcacccccgcccaggagatcgagatgctgaagaagaacaagatctacttcatgcacagacaggacgtgctggacaagaaccacgtggccgacatcgacaagctgatcgactacgccgccagcggcgaccccaccagccccgacaacatcgacagccccaacaccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5072 - RNA, 1302 nt, synthetic construct
  misc_feature 1..1302: note = derived and/or modified CDS sequence (opt4) from PUUV(Djaknebole_98-1)__AM746310.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccacccaggagatcgagttcctgaagaagaacaaggtgtacttcatggacagacagaacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggaccccctgaagatctga

SEQ ID NO: 5073 - RNA, 1302 nt, synthetic construct
  misc_feature 1..1302: note = derived and/or modified CDS sequence (opt4) from PUUV(Fusong 114-05)__EF488804.1__N
  source 1..1302: mol_type = other RNA
atgagcgacctgaaggacatccaggaggacatcgccagacacgagcagcagctggtggtggccagacagaagctgagagacgccgagaaggccgtggagatggaccccgacgacgtgaacaagaacaccctgcaggccagacagcagaccgtgagcgccctggaggacaagatcgccgacttcaagagaagaatggccgacatcgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacatcatcgagttcaccctgcccatcatcctgaaggccctgtacatgctgagcaccagaggcagacagaccgccaaggagaacaagggcaccagaatcagattcaaggacgacaccagcttcgaggacgtgaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgccaaggactggcccgacagaatcaaggagttcatggagaaggagtgccccttcatcaagcccgaggtgaagcccggcacccccgccaaggaggtggagatcctgaagagaaacaagatctacttcatgcagagacagggcgtgctggacaagaaccacgtgcccgacatcgacaagctgatcgactacgccgccagcggcgaccccaccagccccagaaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaagcctggcccaggccctgatcgaccagaaggtgaaggagatcagcaaccaggagcccctgaagatctga

SEQ ID NO: 5074 - RNA, 1302 nt, synthetic construct
  misc_feature 1..1302: note = derived and/or modified CDS sequence (opt4) from PUUV(Fusong 199-05)__EF488803.1__N
  source 1..1302: mol_type = other RNA
atgagcgacctgaaggacatccaggaggacatcgccagacacgagcagcagctggtggccgccagacagaagctgagagacgccgagaaggccgtggagatggaccccgacgacgtgaacaagaacaccctgcaggccagacagcagaccgtgagcgccctggaggacaagatcgccgacttcaagagaagaatggccgacatcgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacatcatcggcttcaccctgcccatcatcctgaaggccctgtacatgctgagcaccagaggcagacagaccgtgaaggagaacaagggcaccagaatcagattcaaggacgacaccagcttcgaggacgtgaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgccaaggactggcccgacagaatcaaggagttcatggagaaggagtgccccttcatcaagcccgaggtgaagcccggcacccccgccaaggaggtggagatcctgaagagaaacaagatctacttcatgcagagacaggacgtgctggacaagaaccacgtgcccgacatcgacaagctgatcgactacgccgccagcggcgaccccaccagccccgagaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaagcctggcccaggccctgatcgaccagaaggtgaaggagatcagcaaccaggagcccctgaagatctga

SEQ ID NO: 5075 - RNA, 1302 nt, synthetic construct
  misc_feature 1..1302: note = derived and/or modified CDS sequence (opt4) from PUUV(Fusong 200-05)__EF211820.1__N
  source 1..1302: mol_type = other RNA
atgagcgacctgaaggacatccaggaggacatcgccagacacgagcagcagctggtggtggccagacagaagctgagagacgccgagaaggccgtggagatggaccccgacgacgtgaacaagaacaccctgcaggccagacagcagaccgtgagcgccctggaggacaagatcgccgacttcaagagaagaatggccgacatcgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacatcatcggcttcaccctgcccatcatcctgaaggccctgtacatgctgagcaccagaggcagacagaccgtgaaggagaacaagggcaccagaatcagattcaaggacgacaccagcttcgaggacgtgaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgccaaggactggcccgacagaatcaaggagttcatggagaaggagtgccccttcatcaagcccgaggtgaagcccggcacccccgccaaggaggtggagatcctgaagagaaacaagatctacttcatgcagagacaggacgtgctggacaagaaccacgtgcccgacatcgacaagctgatcgactacgccgccagcggcgaccccaccagccccgagaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaagcctggcccaggccctgatcgaccagaaggtgaaggagatcagcaaccaggagcccctgaagatctga

SEQ ID NO: 5076 - RNA, 1302 nt, synthetic construct
  misc_feature 1..1302: note = derived and/or modified CDS sequence (opt4) from PUUV(Fusong 900-06)__EF488806.1__N
  source 1..1302: mol_type = other RNA
atgagcgacctgaaggacatccaggaggacatcgccagacacgagcagcagctggtggtggccagacagaagctgagagacgccgagaaggccgtggagatggaccccgacgacgtgaacaagaacaccctgcaggccagacagcagaccgtgagcgccctggaggacaagatcgccgacttcaagagaagaatggccgacatcgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacatcatcggcttcaccctgcccatcatcctgaaggccctgtacatgctgagcaccagaggcagacagaccgtgaaggagaacaagggcaccagaatcagattcaaggacgacaccagcttcgaggacgtgaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgccaaggactggcccgacagaatcaaggagttcatggagaaggagtgccccttcatcaagcccgaggtgaagcccggcacccccgccaaggaggtggagatcctgaagagaaacaagatctacttcatgcagagaagagacgtgctggacaagaaccacgtgcccgacatcgacaagctgatcgactacgccgccagcggcgaccccaccagccccgagaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctacaagagctacctgagaagaacccagagcatgggcatccagctggaccagagaatcatcctgctgtacatgctggagtggggcaaggagatggtggaccacttccacctgggcgacgacatggaccccgagctgagaagcctggcccaggccctgatcgaccagaaggtgaaggagatcagcaaccaggagcccctgaagatctga

SEQ ID NO: 5077 - RNA, 1302 nt, synthetic construct
  misc_feature 1..1302: note = derived and/or modified CDS sequence (opt4) from PUUV(Gumboda_98-2)__AM746316.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccacccaggagatcgagttcctgaagaagaacaaggtgtacttcatggacagacagaacgtgctggagaagaaccacgtggccgacatcgacaagctgatcgactacgccgccagcggcgaccccaccagccccgacaacatcgagagccccaacgccccctgggtgttcagctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggaccccctgaagatctga

SEQ ID NO: 5078 - RNA, 1302 nt, synthetic construct
  misc_feature 1..1302: note = derived and/or modified CDS sequence (opt4) from PUUV(Gumboda_98-4)__AM746318.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccacccaggagatcgagttcctgaagaagaacaaggtgtacttcatggacagacagaacgtgctggacaagaaccacgtggccgacatcgacaagctgatcgactacgccgccagcggcgaccccaccagccccgacaacatcgagagccccaacgccccctgggtgttcagctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggaccccctgaagatctga

SEQ ID NO: 5079 - RNA, 1302 nt, synthetic construct
  misc_feature 1..1302: note = derived and/or modified CDS sequence (opt4) from PUUV(Kamiiso-8Cr-95)__AB010730.1__N
  source 1..1302: mol_type = other RNA
atgagcgacctgaaggacatccaggaggacatcaccagacacgagcagcagctggtggtggccagacagaagctgagagacgccgagaaggccgtggagatggaccccgacgacgtgaacaagaacaccctgcaggccagacagcagaccgtgagcgccctggaggacaagctggccgacttcaagagaagaatggccgacgtggtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacatcatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagatcacccccggcagattcagaaccatcgtgtgcggcctgttccccacccagatccaggtgagaaacatcatgagccccgtgatgggcgtgatcggcttcagcttcttcgtgaaggactggcccgagagaatcaaggagttcatggagaaggagtgccccttcatcaagcccgaggtgaagcccggcacccccgccaaggaggtggagatcctgaagagaaacaaggtgtacttcatgcagagacaggacgtgctggacaagaaccacgtgcccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5080 - RNA, 1302 nt, synthetic construct
  misc_feature 1..1302: note = derived and/or modified CDS sequence (opt4) from PUUV(Mu/07/1219)__KJ994776.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgaggtgaagcccggcacccccgcccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5081 - RNA, 1302 nt, synthetic construct
  misc_feature 1..1302: note = derived and/or modified CDS sequence (opt4) from PUUV(Opina916)__AF294652.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccgtggaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgaggtgaagcccggcacccccgcccaggaggccgagttcctgaagaagaacagaatctacttcatgcagagacaggaggtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5082 - RNA, 1302 nt, synthetic construct
  misc_feature 1..1302: note = derived and/or modified CDS sequence (opt4) from PUUV(Palbole_98-1)__AM746327.1__N
  source 1..1302: mol_type = other RNA
atgagcgacctgaccgacatccaggaggacatcacctgccacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccacccaggagatcgagttcctgaagaagaacaaggtgtacttcatggacagacagaacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggaccccctgaagatctga

SEQ ID NO: 5083 - RNA, 1302 nt, synthetic construct
  misc_feature 1..1302: note = derived and/or modified CDS sequence (opt4) from PUUV(Palbole_98-2)__AM746328.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccacccaggagatcgagttcctgaagaagaacaaggtgtacttcatggacagacagaacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcttcgcccaggccctgatcgaccagaaggtgaaggagatcagcaaccaggaccccctgaagatctga

SEQ ID NO: 5084 - RNA, 1302 nt, synthetic construct
  misc_feature 1..1302: note = derived and/or modified CDS sequence (opt4) from PUUV(Palbole_98-3)__AM746329.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccacccaggagatcgagttcctgaagaagaacaaggtgtacttcatggacagacagaacgtgctggacaagaaccacgtggccgacatcgacaagctgatcgactacgccgccagcggcgaccccaccagccccgacagcatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggaccccctgaagatctga

SEQ ID NO: 5085 - RNA, 1302 nt, synthetic construct
  misc_feature 1..1302: note = derived and/or modified CDS sequence (opt4) from PUUV(PUUV/Ardennes/Mg156/2011)__KT247592.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccgcccaggaggtggagttcctgaagagaaacaagatctacttcatgcagagacaggacgtgctggacaagaaccacgtggccgacatcgacaagctgatcgactacgccgccagcggcgaccccaccagccccgacaacatcgaggcccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5086 - RNA, 1302 nt, synthetic construct
  misc_feature 1..1302: note = derived and/or modified CDS sequence (opt4) from PUUV(PUUV/Jelgava/Mg136/2008)__JN657230.1__N
  source 1..1302: mol_type = other RNA
atgagcgacctggccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccgtggtgtgcggcctgttccccacccagatccaggtgagaaacatcatgagccccgtgatgggcgtgatcggcttcagcttcttcgtgaaggactggcccgacagaatcaaggagttcatggagaaggagagccccttcatcaagcccgacgtgaagcccggcacccccgcccaggaggtggagttcctgaagagaaacaaggtgtacttcatgaacagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5087 - RNA, 1302 nt, synthetic construct
  misc_feature 1..1302: note = derived and/or modified CDS sequence (opt4) from PUUV(PUUV/Jelgava/Mg140/2008)__JN657231.1__N
  source 1..1302: mol_type = other RNA
atgagcgacctggccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccgtggtgtgcggcctgttccacacccagatccaggtgagaaacatcatgagccccgtgatgggcgtgatcggcttcagcttcttcgtgaaggactggcccgacagaatcaaggagttcatggagaaggagtgccccttcatcaagcccgacgtgaagcccggcacccccgcccaggaggtggagttcctgaagagaaacaaggtgtacttcatgaacagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5088 - RNA, 1302 nt, synthetic construct
  misc_feature 1..1302: note = derived and/or modified CDS sequence (opt4) from PUUV(PUUV/Jura/Mg2/2010)__KT247596.2__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgagatcaagcccggcacccccgcccaggaggccgagttcctgaagagaaacaagatctacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5089 - RNA, 1302 nt, synthetic construct
  misc_feature 1..1302: note = derived and/or modified CDS sequence (opt4) from PUUV(PUUV/Madona/Mg233/2008)__JN657232.1__N
  source 1..1302: mol_type = other RNA
atgagcgacctggccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcagcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgacagaatcaaggagttcatggagaaggagtgccccttcatcaagcccgacgtgaagcccggcacccccgcccaggagatcgagttcctgaagagaaacaaggtgtacttcatgaacagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5090 - RNA, 1302 nt, synthetic construct
  misc_feature 1..1302: note = derived and/or modified CDS sequence (opt4) from PUUV(PUUV/Orleans/Mg23/2010)__KT247594.1__N
  source 1..1302: mol_type = other RNA
atgagcgacctgaccgacatccaggaggtgatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcaaggagttcatggagaaggagtgccccttcatcaagcccgaggtgaagcccggcacccccgtgaaggaggccgagttcctgaagaagaacagagtgtacttcatgcagagacaggacgtgctggacaagaaccacgtggccgacatcgacaagctgatcgactacgccgccgccggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5091 - RNA, 1302 nt, synthetic construct
  misc_feature 1..1302: note = derived and/or modified CDS sequence (opt4) from PUUV(Tobetsu-60Cr-93)__AB010731.1__N
  source 1..1302: mol_type = other RNA
atgagcgacctgaaggacatccaggaggacatcaccagacacgagcagcagctggtggtggccagacagaagctgagagacgccgagaaggccgtggagatggaccccgacgacgtgaacaagaacaccctgcaggccagacagcagaccgtgagcgccctggaggacaagctggccgacttcaagagaagaatggccgacgtggtgagcagaaagaagatggacaccaagcccgccgaccccaccggcatcgagcccgacgaccacctgaaggacagaagcagcctgagatacggcaacgtgctggacgtgaacgccatcgacatcgaggagcccagcggccagaccgccgactggtacaccatcggcgtgtacatcatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagatcacccccggcagattcagaaccatcgtgtgcggcctgttccccacccagatccaggtgagaaacatcatgagccccgtgatgggcgtgatcggcttcagcttcttcgtgaaggactggcccgagagaatcaaggagttcatggagaaggagtgccccttcatcaagcccgaggtgaagcccggcacccccgccaaggaggtggagatcctgaagagaaacaaggtgtacttcatgcagagacaggacgtgctggacaagaaccacgtgcccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5092 - RNA, 1302 nt, synthetic construct
  misc_feature 1..1302: note = derived and/or modified CDS sequence (opt4) from PUUV(Vranica)__U14137.1__N
  source 1..1302: mol_type = other RNA
atgagcgacctgaccgacatccaggaggacatcaccagacacgagcagcagctggtggtggccagacagaagctgaaggacgccgagaaggccgtggagatgtaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagatacagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccacccaggagatcgagttcctgaagaagaacaaggtgtacttcatggacagacagaacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggaccccctgaagatctga

SEQ ID NO: 5093 - RNA, 1302 nt, synthetic construct
  misc_feature 1..1302: note = derived and/or modified CDS sequence (opt4) from PUUV(P360)__L11347.1__N
  source 1..1302: mol_type = other RNA
atgagcgacctgaccgacatccaggaggagatcaccagacacgagcagcagctggtggtggccagacagaagctgaaggacgccgagagagccgtggaggtgtaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagaagatcagagagttcatggagaaggagtgccccttcatcaagcccgaggtgaagcccggcacccccgcccaggaggtggagttcctgaagagaaacagagtgtacttcatgaccagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccagagcctgatcgaccagaaggtgaaggagatcagcaaccaggagcccctgaagatctga

SEQ ID NO: 5094 - RNA, 1302 nt, synthetic construct
  misc_feature 1..1302: note = derived and/or modified CDS sequence (opt4) from PUUV(Aijajarvi/Mg7/05)__GQ339476.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaagggctgggccgacagaatcagagagttcatggagaaggagtgccccttcatcaagcccgaggtgaagcccggcacccccacccaggaggtggagttcctgaagaagaacaaggtgtacttcctggacagacagaacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5095 - RNA, 1302 nt, synthetic construct
  misc_feature 1..1302: note = derived and/or modified CDS sequence (opt4) from PUUV(Bavaria 151/05)__EU439968.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcctgaagcccgagatcaagcccggcacccccgcccaggaggccgagttcctgaagaagaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5096 - RNA, 1302 nt, synthetic construct
  misc_feature 1..1302: note = derived and/or modified CDS sequence (opt4) from PUUV(Bavaria 159/05)__EU439972.1__N
  source 1..1302: mol_type = other RNA
atgagcgacctgaccgacatccacgaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgagatcaagcccggcacccccgcccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5097 - RNA, 1299 nt, synthetic construct
  misc_feature 1..1299: note = derived and/or modified CDS sequence (opt4) from PUUV(Bavaria CG 33/04)__DQ016430.2__N
  source 1..1299: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgagatcaagcccggcacccccgcccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5098 - RNA, 1302 nt, synthetic construct
  misc_feature 1..1302: note = derived and/or modified CDS sequence (opt4) from PUUV(Bavaria CG 34/04)__AY954723.2__N
  source 1..1302: mol_type = other RNA
atgagcgacctgaccgacatccaggaggacatcaccagacacgagcagcagctggtggtggccagacagaagctgaaggacgccggcaaggccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgagatgaagcccggcacccccgcccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5099 - RNA, 1302 nt, synthetic construct
  misc_feature 1..1302: note = derived and/or modified CDS sequence (opt4) from PUUV(Bavaria CG 41/04)__DQ016432.2__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaacctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgagatgaagcccggcacccccgcccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5100 - RNA, 1302 nt, synthetic construct
  misc_feature 1..1302: note = derived and/or modified CDS sequence (opt4) from PUUV(Bavaria CG 9/04)__AY954722.2__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgagatgaagcccggcatccccgcccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5101 - RNA, 1302 nt, synthetic construct
  misc_feature 1..1302: note = derived and/or modified CDS sequence (opt4) from PUUV(Bergsjobo/Mg25/05)__GQ339483.1__N
  source 1..1302: mol_type = other RNA
atgagcgacctggccgacatccaggacgagatcaccagacacgagcagcagctggtggccgccagacagaagctgaaggacgccgagagagccgtggaggtggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgaggtgaagcccggcacccccgcccaggaggtggagttcctgaagaagaacaagatctacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5102 - RNA, 1302 nt, synthetic construct
  misc_feature 1..1302: note = derived and/or modified CDS sequence (opt4) from PUUV(CG14444)__AJ277075.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccgcccaggaggccgagttcctgaagagaaacaagatctacttcatgcagagacaggaggtgctggacaagaaccacgtggccgacatcgacaagctgatcgactacgccgccagcggcgaccccaccagccccgacaacatcgaggcccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5103 - RNA, 1302 nt, synthetic construct
  misc_feature 1..1302: note = derived and/or modified CDS sequence (opt4) from PUUV(CG14445)__AJ277076.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccgcccaggaggccgagttcctgaagagaaacatcatctacttcatgcagagacaggaggtgctggacaagaaccacgtggccgacatcgacaagctgatcgactacgccgccagcggcgaccccaccagccccgacaacatcgaggcccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5104 - RNA, 1302 nt, synthetic construct
  misc_feature 1..1302: note = derived and/or modified CDS sequence (opt4) from PUUV(CG1820/POR)__KT885052.1__N
  source 1..1302: mol_type = other RNA
atgagcgacctgaccgacatccaggaggagatcaccagacacgagcagcagctggtggtggccagacagaagctgaaggacgccgagagagccgtggaggtggaccccgacgacgtgaacaagagcaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagaagatcagagagttcatggagaaggagtgccccttcatcaagcccgaggtgaagcccggcacccccgcccaggaggtggagttcctgaagagaaacagagtgtacttcatgaccagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccagagcctgatcgaccagaaggtgaaggagatcagcaaccaggagcccctgaagatctga

SEQ ID NO: 5105 - RNA, 1302 nt, synthetic construct
  misc_feature 1..1302: note = derived and/or modified CDS sequence (opt4) from PUUV(Couvin/59Cg/97)__AJ277034.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccgcccaggaggccgagttcctgaagagaaacaagatctacttcatgcagagacaggacgtgctggacaagaaccacgtggccgacatcgacaagctgatcgactacgccgccagcggcgaccccaccagccccgacaacatcgaggcccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5106 - RNA, 1302 nt, synthetic construct
  misc_feature 1..1302: note = derived and/or modified CDS sequence (opt4) from PUUV(Evo/12Cg/93)__Z30702.1__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgagatcaagcccggcacccccgcccaggagatggagatgctgaagagaaacaagatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgagaaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5107 - RNA, 1302 nt, synthetic construct
  misc_feature 1..1302: note = derived and/or modified CDS sequence (opt4) from PUUV(Evo/14Cg/93)__Z30704.1__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccaactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgagatcaagcccggcacccccgcccaggagatggagatgctgaagagaaacaagatctacttcatgcagagacaggacgtgctggacaagaaccacgtggccgacatcgacaagctgatcgactacgccgccagcggcggccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5108 - RNA, 1302 nt, synthetic construct
  misc_feature 1..1302: note = derived and/or modified CDS sequence (opt4) from PUUV(Evo/15Cg/93)__Z30705.1__N
  source 1..1302: mol_type = other RNA
atgagcgacctgaccgacatccaggaggacatcaccagacacgagcagcagctggtggtggccagacagggcctgaaggacgccgagagagccgtggaggtggaccccgacgacgtgaacaagaacgccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgttcgacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgagatcaagcccggcacccccgcccaggagatggagatgctgaagagaaacaagatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5109 - RNA, 1302 nt, synthetic construct
  misc_feature 1..1302: note = derived and/or modified CDS sequence (opt4) from PUUV(Faboviken/Mg26/05)__GQ339484.1__N
  source 1..1302: mol_type = other RNA
atgagcgacctggccgacatccaggacgagatcaccagacacgagcagcagctggtggccgccagacagaagctgaaggacgccgagagagccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagatcagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgaggtgaagcccggcacccccgcccaggaggtggagttcctgaagaagaacaagatctacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5110 - RNA, 1302 nt, synthetic construct
  misc_feature 1..1302: note = derived and/or modified CDS sequence (opt4) from PUUV(Fyn)__AJ238791.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgagctgaagcccggcaccaacgcccaggaggccgagttcctgaagaagaacagagtgtacttcctgaacagacaggacgtgctggacaagaaccacgtggccgacatcgacaagctgatcgactacgccgccagcggcgaccccaccagccccgacaacatcgaggcccccaacgccccctgggtgttcagctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5111 - RNA, 1302 nt, synthetic construct
  misc_feature 1..1302: note = derived and/or modified CDS sequence (opt4) from PUUV(Fyn131)__AJ278093.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctggaggccagacagcagaccgtgagcgccctggaggacaagctggccgacttcaagagaagaatgaccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccccagcaccatgaaggccgaggagctgacccccggcagattcagaaccatcgtgtgcggcctgttccccacccagatccaggtgagaaacatcatgagccccgtgatgggcgtgatcggcagcagcttcttcgtgaaggactgggccgacagaatcagagagttcatggagaaggagtgccccttcgtgaagcccgagctgaagcccggcaccaacgcccaggaggccgagttcctgaagaagaacagagtgtacttcatgaacagacaggacgtgctggacaagaaccacgtggccgacatcgacaagctgatcgactacgccgccagcggcgaccccacctgccccgacaacatcgaggcccccaacgccccctggggcttcgcctgcgccccccacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcagagagatggtggaccacttccacctgggcgacgacatggaccccgagctgagaggcctggcccaggccctgatcaaccagaaggtgaaggagatcagcaaccaggagcccctgaagatctga

SEQ ID NO: 5112 - RNA, 1302 nt, synthetic construct
  misc_feature 1..1302: note = derived and/or modified CDS sequence (opt4) from PUUV(Fyn47)__AJ278092.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccccagcaccatgaaggccgaggagctgacccccggcagattcagaaccatcgtgtgcggcctgttccccacccagatccaggtgagaaagatcatgagccccgtgatgggcgtgatcggcttcagcttcttcgtgaaggactgggtggagagaatcagagagttcatggagaaggagtgccccttcgtgaagcccgagctgaagcccggcaccaacgcccaggaggccgagttcctgaagaagaacagagtgtacttcatgaacagacaggacgtgctggacaagaaccacgtggccgacatcgacaagctgatcgactacgccgccagcggcgaccccaccagccccgacaacatcgaggcccccaacgccccctgggtgttcgcctgcgccccccacagatgcccccccacctgcatctacgtggccggcatggccgagctgggcgccttcttcagcatcctgcaggacatgagaaacgccatcatggccagcaagaccgtgggcaccgccgaggagaagctgaagaagaagagcagcttctaccagagctacctgagaagaacccagagcgtgggcatccagctggaccagagaatcatcctgctgtacatgctggagtggggcagagagatggtggaccacttccacctgggcgacgacatggaccccgagctgagaggcctggcccaggccctgatcgaccagaaggtgaaggagatcagcaaccaggagcccctgaagatctga

SEQ ID NO: 5113 - RNA, 1302 nt, synthetic construct
  misc_feature 1..1302: note = derived and/or modified CDS sequence (opt4) from PUUV(Gomselga)__AJ238790.1__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaaagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggaccccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggagatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcgtgagccccgtgatgggcgtgatcggcttcagcttcttcgtgaaggactggagccagagaatcaccgagttcatggagaaggagtgccccttcatcaagcccgaggtgaagcccggcacccccgcccaggagatcgagatgttcaagagaaacaagatctacttcatgcagagacaggacgtgctggacaagaaccacgtggccgacatcgacaagagcatcgactacgccgccagcgaggaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5114 - RNA, 1302 nt, synthetic construct
  misc_feature 1..1302: note = derived and/or modified CDS sequence (opt4) from PUUV(Gyttjea/Mg19/05)__GQ339480.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcgccttcttcgtgaagggctgggccgacagaatcagagagttcatggagaaggagtgccccttcatcaagcccgaggtgaagcccggcacccccacccaggagatcgagttcctgaagaagaacaaggtgtacttcctggacagacagaccgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5115 - RNA, 1302 nt, synthetic construct
  misc_feature 1..1302: note = derived and/or modified CDS sequence (opt4) from PUUV(Karhumaki)__AJ238788.1__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaaagatggccgacgccgtgagcagaaagaagatggacaccaagcccaccgaccccaccggcatgaagcccgacgtgcacctgaaggagagaagcagcctggagtacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggagcgagagaatcagagagttcatggagaaggagtgccccttcatcaagcccgaggtgaagcccggcacccccgcccaggagatcgagatgctgagaagaaacaagatctacttcatgcagagacaggacgtgctggacaagaaccacgtggccgacatcgacaagctgatcgacctggccgccagcggcgaccccaccagccccgacaacatcgacagccccaacgccccctgggtgttcgcctgcgcccccgtgagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5116 - RNA, 1302 nt, synthetic construct
  misc_feature 1..1302: note = derived and/or modified CDS sequence (opt4) from PUUV(Kolodozero)__AJ238789.1__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgatccccacccagatccaggtgagaaacatcatgagccccgtgatgggcgtgatcggcttcagcttcttcgtgaaggactggagcgagagaatcagagagttcatggagaaggagtgccccttcatcaagcccgaggtgaagcccggcaccagcgcccaggagatcgagatgctgaagagaaacaagatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccccctggaccagagaatcatcctgctgttcatgctggagtggggccaggagatggtggaccacttccacctgggcgacgacatggaccccgagctgagaggcctggcccaggccctgatcgaccagaaggtgaaggagatcagcaaccaggagcccctgaagatctga

SEQ ID NO: 5117 - RNA, 1302 nt, synthetic construct
  misc_feature 1..1302: note = derived and/or modified CDS sequence (opt4) from PUUV(Kuhmo/X11)__GU808825.1__N
  source 1..1302: mol_type = other RNA
atgagcgacctgaccgacatccaggaggacatcaccagacacgagcagcagctggtggtggccagacagaagctgaaggacgccgagagagccgtgggcgtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggagcgagagaatcagagagttcatggagaaggagtgccccttcatcaagcccgaggtgaagcccggcacccccgcccaggagatcgagatgctgaagagaaacagaatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccagcgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5118 - RNA, 1302 nt, synthetic construct
  misc_feature 1..1302: note = derived and/or modified CDS sequence (opt4) from PUUV(Kuhmo/X5)__GU808824.1__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggagcgagagaatcagagagttcatggagaaggagtgccccttcatcaagcccgaggtgaagcccggcacccccgcccaggagatcgagatgctgaagagaaacagaatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5119 - RNA, 1302 nt, synthetic construct
  misc_feature 1..1302: note = derived and/or modified CDS sequence (opt4) from PUUV(Ljustrask/Mg20/05)__GQ339481.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcgccttcttcgtgaagggctgggccgacagaatcagagagttcatggagaaggagtgccccttcatcaagcccgaggtgaagcccggcacccccacccaggagatcgagttcctgaagaagaacaaggtgtacttcctggacagacagaacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5120 - RNA, 1302 nt, synthetic construct
  misc_feature 1..1302: note = derived and/or modified CDS sequence (opt4) from PUUV(Mangelbo/Mg1/05)__GQ339485.1__N
  source 1..1302: mol_type = other RNA
atgagcgacctgaccgacatccaggacgagatcaccagacacgagcagcagctggtggccgccagacagaagctgaaggacgccgagagagccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcgacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggacaaggagtgccccttcatcaagcccgaggtgaagcccggcacccccgcccaggagatcgagttcctgaagaagaacaagatctacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctgacccaggccctgatcgaccagaaggtgaaggagatcagcaaccccgagcccctgaagatctga

SEQ ID NO: 5121 - RNA, 1302 nt, synthetic construct
  misc_feature 1..1302: note = derived and/or modified CDS sequence (opt4) from PUUV(Momignies/55Cg/96)__AJ277033.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagaagcaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccgcccaggaggccgagttcctgaagagaaacaagatctacttcatgcagagacaggacgtgctggacaagaaccacgtggccgacatcgacaagctgatcgactacgccgccagcggcgaccccaccagccccgacaacatcgaggcccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgagcgacgacatggaccccgagctgagaggcctggcccaggccctgatcgaccagaaggtgaaggagatcagcaaccaggagcccctgaagatctga

SEQ ID NO: 5122 - RNA, 1302 nt, synthetic construct
  misc_feature 1..1302: note = derived and/or modified CDS sequence (opt4) from PUUV(Montbliart/23Cg/96)__AJ277031.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccgcccaggaggccgagttcctgagaagaaacaagatctacttcatgcagagacaggaggtgctggacaagaaccacgtggccgacatcgacaagctgatcgactacgccgccagcggcgaccccaccagccccgacaacatcgaggcccccaacgccccctgggtgttcgcctgcgcccccgacagatgcccccccacctgcatctacatcgccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5123 - RNA, 1302 nt, synthetic construct
  misc_feature 1..1302: note = derived and/or modified CDS sequence (opt4) from PUUV(MuEb10Karlstadt/10)__JN696373.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgagatcaagcccggcacccccgtgcaggaggccgagttcctgaagagaaacaaggtgtacttcatgcagagacaggaggtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5124 - RNA, 1302 nt, synthetic construct
  misc_feature 1..1302: note = derived and/or modified CDS sequence (opt4) from PUUV(MuEb12Lackenberg/10)__JN696374.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgagatgaagcccggcacccccgcccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5125 - RNA, 1302 nt, synthetic construct
  misc_feature 1..1302: note = derived and/or modified CDS sequence (opt4) from PUUV(Munga/Mg16/05)__GQ339487.1__N
  source 1..1302: mol_type = other RNA
atgagcgacctgaccgacatccaggacgagatcaccagacacgagcagcagctggtggccgccagacagaagctgaaggacgccgagagagccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgaggtgaagcccggcacccccgcccaggagatcgagttcctgaagaagaacaagatctacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5126 - RNA, 1302 nt, synthetic construct
  misc_feature 1..1302: note = derived and/or modified CDS sequence (opt4) from PUUV(Munga/Mg2/05)__GQ339486.1__N
  source 1..1302: mol_type = other RNA
atgagcgacctgaccgacatccaggacgagatcaccagacacgagcagcagctggtggccgccagacagaagctgaaggacgccgagagagccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacatgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgagagaatcagagagttcatggagaaggagtgccccttcatcaagcccgaggtgaagcccggcacccccgcccaggagatcgagttcctgaagaagaacaagatctacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5127 - RNA, 1302 nt, synthetic construct
  misc_feature 1..1302: note = derived and/or modified CDS sequence (opt4) from PUUV(PUU/Cg-Erft)__AJ238779.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcaagaagttcatggagaaggagtgccccttcatcaagcccgaggtgaagcccggcacccccagccaggaggccgagttcctgaagatgaacagaatctacttcatgcagagacaggaggtgctggacaagaaccacgtggccgacatcgacaagctgatcgactacgccgccagcggcgaccccaccagccccgacaacatcgaggcccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5128 - RNA, 1302 nt, synthetic construct
  misc_feature 1..1302: note = derived and/or modified CDS sequence (opt4) from PUUV(Puu/Kazan)__Z84204.1__N
  source 1..1302: mol_type = other RNA
atgagcgacctgaccgacatccaggaggagatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagacttcatggagaaggagagccccttcatcaagcccgaggtgaagcccggcacccccgcccaggagatcgagttcctgaagagaaacagagtgtacttcatgaccagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccagagcctgatcgaccagaaggtgaaggagatcagcaaccaggagcccctgaagatctga

SEQ ID NO: 5129 - RNA, 1302 nt, synthetic construct
  misc_feature 1..1302: note = derived and/or modified CDS sequence (opt4) from PUUV(PUU/Mignovillard/CgY02/2005)__AM695638.1__N
  source 1..1302: mol_type = other RNA
atgggcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggaccgacagaatcagagagttcatggagaaggagtgccccttcatcaagcccgagatgaagcccggcacccccgcccaggaggccgagttcctgaagagaaacaagatctacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5130 - RNA, 1302 nt, synthetic construct
  misc_feature 1..1302: note = derived and/or modified CDS sequence (opt4) from PUUV(PUUV/Croatia_Gerovo/Mg938/2008)__KC676609.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatgggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggagcgagagagtgagagacttcatggagaaggagtgccccttcatcaagcccgagatcaagcccggcaccccccagcaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5131 - RNA, 1302 nt, synthetic construct
  misc_feature 1..1302: note = derived and/or modified CDS sequence (opt4) from PUUV(PUUV/Croatia_Gerovo/Mg979/2008)__KC676613.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggagcgagagagtgagagacttcatggagaaggagtgccccttcatcaagcccgagatcaagcccggcacccccccccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5132 - RNA, 1302 nt, synthetic construct
  misc_feature 1..1302: note = derived and/or modified CDS sequence (opt4) from PUUV(PUUV/Konnevesi/Mg_M114B/2005)__JQ319171.1__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgaggtgaagcccggcacccccgcccaggagatcgagatgctgaagagaaacaagatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacttcggcgacgacatggaccccgagctgagaggcctggcccaggccctgatcgaccagaaggtgaaggagatcagcaaccaggagcccctgaagatctga

SEQ ID NO: 5133 - RNA, 1302 nt, synthetic construct
  misc_feature 1..1302: note = derived and/or modified CDS sequence (opt4) from PUUV(PUUV/Konnevesi/Mg_M94A/2005)__JQ319163.2__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcaaggagttcatggagaaggagtgccccttcatcaagcccgaggtgaagcccggcacccccgcccaggagatcgagatgctgaagagaaacaagatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggaggaggtgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccatgatcgaccagaaggtgaaggagatcagcaaccaggagcccctgaagatctga

SEQ ID NO: 5134 - RNA, 1302 nt, synthetic construct
  misc_feature 1..1302: note = derived and/or modified CDS sequence (opt4) from PUUV(PUUV/Konnevesi/Mg_O14B/2005)__JQ319166.1__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgaggtgaagcccggcacccccgcccaggagatcgagatgctgaagagaaacaagatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5135 - RNA, 1302 nt, synthetic construct
  misc_feature 1..1302: note = derived and/or modified CDS sequence (opt4) from PUUV(PUUV/Konnevesi/Mg_O22B/2005)__JQ319168.2__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgaggtgaagcccggcacccccgcccaggagatcgagatgctgaagagaaacaagatctacttcatgcagagacaggacgtgctggacaagaaccacgtggccgacatcgacaagctgatcgactacgccgccagcggcgaccccaccagccccgagaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggccacgcccaggccctgatcgaccagaaggtgaaggagatcagcaaccaggagcccctgaagatctga

SEQ ID NO: 5136 - RNA, 1302 nt, synthetic construct
  misc_feature 1..1302: note = derived and/or modified CDS sequence (opt4) from PUUV(PUUV/Konnevesi/Mg_O57A/2005)__JQ319161.2__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccaccagaatccaggtgagaaacatcatgagccccgtgatgggcgtgatcggcttcagcttcttcgtgaaggactggcccgagagaatcaaggagttcatggagaaggagtgcagcttcatcaagcccgaggtgaagcccggcacccccgcccaggagatcgagatgctgaagagaaacaagatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggaggaggtgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaacgtgaaggagatcagcaaccaggagcccctgaagatctga

SEQ ID NO: 5137 - RNA, 1302 nt, synthetic construct
  misc_feature 1..1302: note = derived and/or modified CDS sequence (opt4) from PUUV(PUUV/Konnevesi/Mg_O6B/2005)__JQ319164.1__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagagccatcgtgtgcggcctgttccccacccagatccaggtgagaaacatcatgagccccgtgatgggcgtgatcggcttcagcttcttcgtgaaggactggcccgagagaatcagagagttcatgggcaaggagtgccccttcatcaagcccgaggtgaagcccggcacccccgcccaggagatcgagatgctgaagagaaacaagatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5138 - RNA, 1302 nt, synthetic construct
  misc_feature 1..1302: note = derived and/or modified CDS sequence (opt4) from PUUV(PUUV/Konnevesi/Mg_O74B/2005)__JQ319170.1__N
  source 1..1302: mol_type = other RNA
atgagcgacctgaccgacatccaggaggacatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgaggtgaagcccggcacccccgcccaggagatcgagatgctgaagagaaacaagatctacttcatgcagagacaggacgtgctggacaagaaccacgtggccgacatcgacaagctgatcgactacgccgccagcggcgaccccaccagccccgacaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgtggaggagaagctgaagaagaagagcagcttctaccagagctacctgagaagaacccagagcatgggcatccagctggaccagagaatcatcctgctgttcatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5139 - RNA, 1302 nt, synthetic construct
  misc_feature 1..1302: note = derived and/or modified CDS sequence (opt4) from PUUV(PUUV/Konnevesi/Mg_O78A/2005)__JQ319162.2__N
  source 1..1302: mol_type = other RNA
atgagcgacctgaccgacatccaggaggacatcaccagacacgagcagcagctggtggtggccagacagaagctgaaggacgccgagaaggccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagaaggagtgccccttcatcaagcccgaggtgaagcccggcacccccgcccaggagatcgagatgctgaagagaaacaagatctacttcatgcagagacaggacgtgctggacaagaaccacgtggccgacatcgacaagctgatcgactacgccgccagcggcgaccccaccagccccgacaacatcgacagccccaacgccccctgggtgctggcctgcggccccgagagatgcccccccacctgcatctacgtggccggcatggccgagctgggcgccttcttcagcatcctgcaggacatgagaaacaccatcatggccagcaagaccgtgggcagcgacgaggtgaagctgaagaagaagagcttcttctaccagtactacctgagaagaacccacagcatgggcatccagctggaccagagaatcatcctgctgtgcatgctggagtggggcatcgagatggtggaccacttccacctgggcgacgacatggaccccgagctgagaggcctggcccaggccatgatcgaccagaaggtgaaggagatcagcaaccaggagcccctgatcatctga

SEQ ID NO: 5140 - RNA, 1302 nt, synthetic construct
  misc_feature 1..1302: note = derived and/or modified CDS sequence (opt4) from PUUV(PUUV/Mg23/HungaryTR17/00)__FN377822.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggagcgagagagtgagagagttcatggagaaggagtgccccttcatcaagcccgagatcaagcccggcacccccccccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5141 - RNA, 1302 nt, synthetic construct
  misc_feature 1..1302: note = derived and/or modified CDS sequence (opt4) from PUUV(PUUV/Mg9/HungaryTR17/00)__FN377821.1__N
  source 1..1302: mol_type = other RNA
atgagcgacctggccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggagcgagagagtgagagagttcatggagaaggagtgccccttcatcaagcccgagatcaagcccggcacccccccccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5142 - RNA, 1302 nt, synthetic construct
  misc_feature 1..1302: note = derived and/or modified CDS sequence (opt4) from PUUV(PUUV/NL/Mg1012/2010)__KU314900.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgacagaatcagagagttcatggagaaggagtgccccttcatcaagcccgaggtgaagcccggcacccccgcccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcgccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5143 - RNA, 1302 nt, synthetic construct
  misc_feature 1..1302: note = derived and/or modified CDS sequence (opt4) from PUUV(PUUV/NL/Mg1439/2011)__KU314901.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcgccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgacagaatcagagagttcatggagagagagtgccccttcatcaagcccgaggtgaagcccggcacccccgcccaggaggccgagttcctgaagagaaacaaggtgtacttcatgcagagacaggacgtgctggacaagaaccacgtggccgacatcgacgagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5144 - RNA, 1302 nt, synthetic construct
  misc_feature 1..1302: note = derived and/or modified CDS sequence (opt4) from PUUV(PUUV/NL/Mg2/2008)__KU314902.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaccaccctgcaggccagacagcagaccgtgagcgccctggaggacaagctggccgacttcaagagacagatggccgacgccgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgacgtgaagcccggcacccccgcccaggaggccgagttcctgaagagaaacaagatctacttcatgcagagacaggaggtgctggacaagaaccacgtggccgacatcgacaagctgatcgactacgccgccagcggcgaccccaccagccccgacaacatcgagagccccaacagcccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtggaggagatcagcaaccaggagcccctgaagatctga

SEQ ID NO: 5145 - RNA, 1302 nt, synthetic construct
  misc_feature 1..1302: note = derived and/or modified CDS sequence (opt4) from PUUV(PUUV/NL/Mg25/2007)__KU314897.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgacagaatcagagagttcatggagaaggagtgccccttcatcaagcccgaggtgaagcccggcacccccgcccaggaggccgagttcctgaagagaaacaaggtgtacttcatgcagagacaggacgtgctggacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5146 - RNA, 1302 nt, synthetic construct
  misc_feature 1..1302: note = derived and/or modified CDS sequence (opt4) from PUUV(PUUV/NL/Mg31/2007)__KU314896.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgacagaatcagagagttcatggagaaggagtgccccttcatcaagcccgaggtgaagcccggcacccccgcccaggaggccgagttcctgaagagaaacaaggtgtacttcatgcagagacaggacgtgcccgacaagaaccacgtggccgacatcgacaagctgatcgactacgccgccagcggcgaccccaccagccccgacaacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5147 - RNA, 1302 nt, synthetic construct
  misc_feature 1..1302: note = derived and/or modified CDS sequence (opt4) from PUUV(PUUV/NL/Mg502/2008)__KU314904.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgacgtgaagcccggcacccccgcccaggaggccgagttcctgaagagaaacaagatctacttcatgcagagacaggaggtgctggacaagaaccacgtggccgacatcgacaagctgatcgactacgccgccagcggcgaccccaccagccccgacaacatcgagagccccgacagcccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5148 - RNA, 1302 nt, synthetic construct
  misc_feature 1..1302: note = derived and/or modified CDS sequence (opt4) from PUUV(PUUV/NL/Mg591/2008)__KU314905.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgacgtgaagcccggcacccccgcccaggaggccgagttcctgaagagaaacaagatctacttcatgcagagacaggaggtgctggacaagaaccacgtggccgacatcgacaagctgatcgactacgccgccagcggcgaccccaccagccccgacaacatcgagagccccaacagcccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaagcctggcccaggccctgatcgaccagaaggtgaaggagatcagcaaccaggagcccctgaagatctga

SEQ ID NO: 5149 - RNA, 1302 nt, synthetic construct
  misc_feature 1..1302: note = derived and/or modified CDS sequence (opt4) from PUUV(Samara_49/CG/2005)__AB433843.2__N
  source 1..1302: mol_type = other RNA
atgagcgacctgaccgacatccaggaggagatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagagttcatggagagagagtgccccttcatcaagcccgaggtgaagcccggcacccccgcccaggaggtggagttcctgaagagaaacagagtgtacttcatgaccagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccagagcctgatcgaccagaaggtgaaggagatcagcaaccaggagcccctgaagatctga

SEQ ID NO: 5150 - RNA, 1302 nt, synthetic construct
  misc_feature 1..1302: note = derived and/or modified CDS sequence (opt4) from PUUV(Thuin/33Cg/96)__AJ277030.1__N
  source 1..1302: mol_type = other RNA
atgagcgacctgaccgacatccaggaggacatcaccagacacgagcagcagctggtggtggccagacagaagctgaaggacgccgagaaggccgtggagatggaccccgacgacgtgaacaagaacaccctgcaggccagacagcagaccgtgagcgccctggaggacaagctggccgacttcaagagacagatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcagagagttcatggagaaggagtgccccttcatcaagcccgaggtgaagcccggcacccccgtgcaggaggccgagttcctgaagagaaacaagatctacttcatgcagagacaggaggtgctggacaagaaccacgtggccgacatcgacaagctgatcgactacgccgccagcggcgaccccaccagccccgacaacatcgaggcccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccaggccctgatcgaccagaaggtgaaggagatcagcaaccaggagcccctgaagatctga

SEQ ID NO: 5151 - RNA, 1302 nt, synthetic construct
  misc_feature 1..1302: note = derived and/or modified CDS sequence (opt4) from PUUV(Udmurtia/338Cg/92)__Z30708.1__N
  source 1..1302: mol_type = other RNA
atgagcgacctgaccgacatccaggaggagatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacagcgtgagcagaaagaagatggacaccaagcccaccgaccccaccggcatcgagcccgacgaccacctgaaggagagaagcagccccagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccatcaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagacttcatggagaaggagtgccccttcatcaagcccgaggtgaagcccggcacccccgcccaggagatcgagttcctgaagagaaacagagtgtacttcatgaccagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccagagcctgatcgaccagaaggtgaaggagatcagcaaccaggagcccctgaagatctga

SEQ ID NO: 5152 - RNA, 1302 nt, synthetic construct
  misc_feature 1..1302: note = derived and/or modified CDS sequence (opt4) from PUUV(Udmurtia/444Cg/88)__Z30706.1__N
  source 1..1302: mol_type = other RNA
atgagcgacctgaccgacatccaggaggagatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagacttcatggagaaggagtgccccttcatcaagcccgaggtgaagcccggcacccccgcccaggagatcgagttcctgaagagaaacagagtgtacttcatgaccagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccagagcctgatcgaccagaaggtgaaggagatcagcaaccaggagcccctgaagatctga

SEQ ID NO: 5153 - RNA, 1302 nt, synthetic construct
  misc_feature 1..1302: note = derived and/or modified CDS sequence (opt4) from PUUV(Udmurtia/894Cg/91)__Z21497.1__N
  source 1..1302: mol_type = other RNA
atgagcgacctgaccgacatccaggaggagatcaccagacacgagcagcagctggtggtggccagacagaagctgaaggacgccgagagagccgtggaggtggaccccgacgacgtgaacaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagagaatcagagacttcatggagaaggagtgccccttcatcaagcccgaggtgaagcccggcacccccgcccaggagatcgagttcctgaagagaaacagagtgtacttcatgaccagacaggacgtgctggacaagaaccacgtggccgacatcgacaagctgatcgactacgccgccagcggcgaccccaccagccccgacgacatcgagagccccaacgccccctgggtgttcgcctgcgcccccgacagatgcccccccacctgcatctacgtggtgggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccagagcctgatcgaccagaaggtgaaggagatcagcaaccaggagcccctgaagatctga

SEQ ID NO: 5154 - RNA, 1302 nt, synthetic construct
  misc_feature 1..1302: note = derived and/or modified CDS sequence (opt4) from PUUV(Fusong-Cr-247)__EF442087.1__N
  source 1..1302: mol_type = other RNA
atgagcgacctgaaggacatccaggaggacatcgccagacacgagcagcagctggtggtggccagacagaagctgagagacgccgagaaggccgtggagatggaccccgacgacgtgaacaacaacaccctgcaggccagacagcagaccgtgagcgccctggaggacaagatcgccgacttcaagagaagaatggccgacatcgtgagcagaaagaagatggacaccaagcccgccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacatcatcggcttcaccctgcccatcatcctgaaggccctgtacatgctgagcaccagaggcagacagaccgtgaaggagaacaagggcaccagaatcagattcaaggacgacaccagcttcgaggacgtgaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacaccatgagccccgtgatgggcgtgatcggcttcagcttcttcgccaaggactggcccgacagaatcaaggagttcatggagaaggagtgccccttcatcaagcccgaggtgaagcccggcacccccgccaaggaggtggagatcctgaagagaaacaagatctacttcatgcagagacaggacgtgctggacaagaaccacgtgcccgacatcgacaagctgatcgactacgccgccagcggcgaccccaccagccccgagaacatcgacagccccaacgccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaagcctggcccaggccctgatcgaccagaaggtgaaggagatcagcaaccaggagcccctgaagatctga

SEQ ID NO: 5155 - RNA, 1302 nt, synthetic construct
  misc_feature 1..1302: note = derived and/or modified CDS sequence (opt4) from MUV(11-4)__JX046484.1__N
  source 1..1302: mol_type = other RNA
atgagcgacctgaaggagatccaggaggacatcgccagacacgagcagcagctggtggtggccagacagaagctgagagacgccgagaaggccgtggaggtggaccccgacgacgtgaacaagaacaccctgcaggccagacagcagaccgtgagcgccctggaggacaagctggccgacttcaagagacagatggccgacttcgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacatcatcggcttcaccctgcccatcgtgctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcaaggagttcatggagaaggagtgccccttcatcaagcccgagcccaagcccggcacccccgccagcgaggtggagttcctgaagagaaacaagatctacttcatgagcagacaggacgtgctggacaagaaccacgtgcccgacatcgacaagctgatcgactacgccgccagcggcgaccccaccagccccgacaacatcgaggaccccaacgccccctgggtgttcagctgcgcccccgacagatgcccccccacctgcctgtacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaaccctggcccaggccctgatcgaccagaaggtgaaggagatcagcaaccaggagcccctgaagatctga

SEQ ID NO: 5156 - RNA, 1302 nt, synthetic construct
  misc_feature 1..1302: note = derived and/or modified CDS sequence (opt4) from MUV(00-18)__DQ138128.1__N
  source 1..1302: mol_type = other RNA
atgagcgacctgaaggagatccaggaggacatcgccagacacgagcagcagctggtggtggccagacagaagctgagagacgccgagaaggccgtggaggtggaccccgacgacgtgaacaagaacaccctgcaggccagacagcagaccgtgagcgccctggaggacaagctggccgacttcaagagacagatggccgacttcgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcgtgctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggtggagagaatcaaggagttcatggagaaggagtgccccttcatcaagcccgagcccaagcccggcacccccgccagcgaggtggagttcctgaagagaaacaagatctacttcatgaacagacaggacgtgctggacaagaaccacgtgcccgacatcgacaagctgatcgactacgccgccagcggcgaccccaccagccccgacaacatcgaggaccccaacgccccctgggtgttcagctgcgcccccgacagatgcccccccacctgcctgtacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaaccctggcccaggccctgatcgaccagaaggtgaaggagatcagcaaccaggagcccctgaagatctga

SEQ ID NO: 5157 - RNA, 1302 nt, synthetic construct
  misc_feature 1..1302: note = derived and/or modified CDS sequence (opt4) from MUV(11-1)__JX028273.1__N
  source 1..1302: mol_type = other RNA
atgagcgacctgaaggagatccaggaggacatcgccagacacgagcagcagctggtggtggccagacagaagctgagagacgccgagaaggccgtggaggtggaccccgacgacgtgaacaagaacaccctgcaggccagacagcagaccgtgagcgccctggaggacaagctggccgacttcaagagacagatggccgacttcgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacatcatcggcttcaccctgcccatcgtgctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggccgacagaatcaaggagttcatggagaaggagtgccccttcatcaagcccgagcccaagcccggcacccccgccagcgagatcgagttcctgaagagaaacaagatctacttcatgagcagacaggacgtgctggacaagaaccacgtgcccgacatcgacaagctgatcgactacgccgccagcggcgaccccaccagccccgacaacatcgaggaccccaacgccccctgggtgttcagctgcgcccccgacagatgcccccccacctgcctgtacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaaccctggcccaggccctgatcgaccagaaggtgaaggagatcagcaaccaggagcccctgaagatctga

SEQ ID NO: 5158 - RNA, 1302 nt, synthetic construct
  misc_feature 1..1302: note = derived and/or modified CDS sequence (opt4) from MUV(96-1)__DQ138133.1__N
  source 1..1302: mol_type = other RNA
atgagcgacctgaaggagatccaggaggacatcgccagacacgagcagcagctggtggtggccagacagaagctgagagacgccgagaaggccgtggaggtggaccccgacgacgtgaacaagaacaccctgcaggccagacagcagaccgtgagcgccctggaggacaagctggccgacttcaagagacagatggccgacttcgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcgtgctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcagattcagcttcctggtgaaggactggagcgagaagatcaaggagttcatggagaaggagtgccccttcatcaagcccgagcccaagcccggcacccccgccagcgagatcgagttcctgaagagaaacaagatctacttcatgaacagacaggacgtgctggacaagaaccacgtgcccgacatcgacaagctgatcgactacgccgccagcggcgaccccaccagccccgacaacatcgaggcccccaacgccccctgggtgttcagctgcgcccccgacagatgcccccccacctgcctgtacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaaccctggcccaggccctgatcgaccagaaggtgaaggagatcagcaaccaggagcccctgaagatctga

SEQ ID NO: 5159 - RNA, 1302 nt, synthetic construct
  misc_feature 1..1302: note = derived and/or modified CDS sequence (opt4) from MUV(99-28)__DQ138142.1__N
  source 1..1302: mol_type = other RNA
atgagcgacctgaaggagatccaggaggacatcgccagacacgagcagcagctggtggtggccagacagaagctgagagacgccgagaaggccgtggaggtggaccccgacgacgtgaacaagaacaccctgcaggccagacagcagaccgtgagcgccctggaggacaagctggccgacttcaagagacagatggccgacttcgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccctgcccatcgtgctgaaggccctgtacatgctgagcaccagaggcagacagaccgtgaaggagaacaagggcaccagaatcagattcaaggacgacaccagcttcgaggacatcaacggcatcagaagccccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactgggtggagagaatcaaggagttcatggagaaggagtgccccttcatcaagcccgagcccaagcccggcacccccgccagcgaggtggagttcctgaagagaaacaagatctacttcatgaacagacaggacgtgctggacaagaaccacgtgcccgacatcgacaagctgatcgactacgccgccagcggcgaccccaccagccccgacaacatcgaggaccccaacgccccctgggtgttcagctgcgcccccgacagatgcccccccacctgcctgtacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaaccctggcccaggccctgatcgaccagaaggtgaaggagatcagcaaccaggagcccctgaagatctga

SEQ ID NO: 5160 - RNA, 1290 nt, synthetic construct
  misc_feature 1..1290: note = derived and/or modified CDS sequence (opt4) from SANGV(SA14)__NC_034526.1__N
  source 1..1290: mol_type = other RNA
atggccaccctggaggagatccagaaggagatcaacatccacgagggccagctgatcatcgccaagcagaaggtgaaggacgccgagaagcagtacgagaaggaccccgacgacctgaacaagagagccctgagcgacagagagggcatcgcccacagcatccagagcaagatcgacgagctgagaagacagctggccgacagagtggccgccggcagaaacctgggccaggagagagaccccaccggcgtggagcccggcgaccacctgagagagaagagcatgctgagctacggcaacgtgatcgacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgaggagatcacccccggcagattcagaaccgccgtgtgcggcctgtaccccgcccagatcaaggccagaaacatggtgagccccgtgatgagcgtgatcggcttcatcaccctggccagagactggaccgagagaatcgagaactggctggaccagccctgcaagttcatgagcgagcccagccagaccagcctgcagaagggccccgccaccaacagagactacctgaaccagagacaggccagcctggcccagatggagaccaaggaggcccaggccgtgagacagcaggccgtggacgccggctgcaacctggtggaccacatcgacagccccagcagcatctgggtgttcgccggcgcccccgacagatgcccccccacctgcctgttcatcagcggcatggccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcatcatgttcatggtggagtggggcaaggaggccgtggacggcttccacctgggcgacgacatggaccccgagctgagaagcttcgcccaggccctgatcgaccagaaggtgaaggagatcagcaaccaggagcccctgaagatctga

SEQ ID NO: 5161 - RNA, 1290 nt, synthetic construct
  misc_feature 1..1290: note = derived and/or modified CDS sequence (opt4) from SANGV(SA22)__JQ082303.1__N
  source 1..1290: mol_type = other RNA
atggccaccctggaggagatccagaaggagatcaacatccacgagggccagctgatcatcgccaagcagaaggtgaaggacgccgagaagcagtacgagaaggaccccgacgacctgaacaagagagccctgagcgacagagagggcatcgcccacagcatccagagcaagatcgacgagctgagaagacagctggccgacagagtggccgccggcagaaacctgggccaggagagagaccccaccggcgtggagcccggcgaccacctgagagagaagagcatgctgagctacggcaacgtgatcgacctgaaccacctggacatcgacgagcccaccggccagaccgccgactggctgagcatcgtgatctacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgaggagatcacccccggcagattcagaaccgccgtgtgcggcctgtaccccgcccagatcaaggccagaaacatggtgagccccgtgatgagcgtgatcggcttcatcaccctggccagagactggaccgagagaatcgagaactggctggaccagccctgcaagttcatgagcgagcccagccagaccagcctgcagaagggccccgccaccaacagagactacctgaaccagagacaggccagcctggcccagatggagaccaaggaggcccaggccgtgagacagcaggccgtggacgccggctgcaacctggtggaccacatcgacagccccagcagcatctgggtgttcgccggcgcccccgacagatgcccccccacctgcctgttcatcagcggcatggccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcatcatgttcatggtggagtggggcaaggaggtggtggacggcttccacctgggcgacgacatggaccccgagctgagaagcttcgcccaggccctgatcgaccagaaggtgaaggagatcagcaaccaggagcccctgaagatctga

SEQ ID NO: 5162 - RNA, 1290 nt, synthetic construct
  misc_feature 1..1290: note = derived and/or modified CDS sequence (opt4) from SEOV(L99)__AF288299.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagaaccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtgtacaacttccacctgggcgacgacatggaccccgagctgagaagcctggcccagatcctgatcgaccagaaggtgaaggagatcagcaaccaggagcccatgaagctgtga

SEQ ID NO: 5163 - RNA, 1290 nt, synthetic construct
  misc_feature 1..1290: note = derived and/or modified CDS sequence (opt4) from SEOV(SG42/2011)__KY807171.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggagcaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggagcagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5164 - RNA, 1290 nt, synthetic construct
  misc_feature 1..1290: note = derived and/or modified CDS sequence (opt4) from SEOV(XJ2/2011)__KY807169.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaagcagacagaccagcaaggacaacaagggcatgagaatcagattcaaggacgacagcagctacgaggacgtgaacggcatcagaaagcccaagcacctgtacgtgagcatgcccaacgcccagagcagcatgagagccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggctgggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5165 - RNA, 1290 nt, synthetic construct
  misc_feature 1..1290: note = derived and/or modified CDS sequence (opt4) from SEOV(XJ5/2011)__KY807170.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcaccccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgagcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5166 - RNA, 1290 nt, synthetic construct
  misc_feature 1..1290: note = derived and/or modified CDS sequence (opt4) from SEOV(10-134)__JF693882.2__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtgctgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5167 - RNA, 1290 nt, synthetic construct
  misc_feature 1..1290: note = derived and/or modified CDS sequence (opt4) from SEOV(DPRK08)__JX853575.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5168 - RNA, 1290 nt, synthetic construct
  misc_feature 1..1290: note = derived and/or modified CDS sequence (opt4) from SEOV(Fj372/2013)__KP645198.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcagccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5169 - RNA, 1290 nt, synthetic construct
  misc_feature 1..1290: note = derived and/or modified CDS sequence (opt4) from SEOV(HeB38)__JN377553.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgaagatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagccccttctaccagagctacctgagaagaacccagagcatgggcatccagctggaccagagaatcatcgtgatgttcatggtggcctggggcaaggaggccgtggacaacttccacctgggcgacgacatggaccccgagctgagaggcctggcccagatcctgatcgaccagaaggtgaaggagatcagcaaccaggagcccatgaagctgtga

SEQ ID NO: 5170 - RNA, 1290 nt, synthetic construct
  misc_feature 1..1290: note = derived and/or modified CDS sequence (opt4) from SEOV(JiangxiXinjianRn-07-2011)__KP859511.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5171 - RNA, 1290 nt, synthetic construct
  misc_feature 1..1290: note = derived and/or modified CDS sequence (opt4) from SEOV(JiangxiXinjianRn-09-2011)__KP859512.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagttcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5172 - RNA, 1290 nt, synthetic construct
  misc_feature 1..1290: note = derived and/or modified CDS sequence (opt4) from SEOV(Singapore/06(RN41))__GQ274944.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaggcctggcccagatcctgatcgaccagaaggtgaaggagatcagcaaccaggagcccatgaagctgtga

SEQ ID NO: 5173 - RNA, 1290 nt, synthetic construct
  misc_feature 1..1290: note = derived and/or modified CDS sequence (opt4) from SEOV(YaluRiver12)__HQ611980.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccggcgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacagcaagggcatgagaatcagattcaaggacgacagcagctacgaggacgtgaacggcatcagaaagcccaagcacctgtacgtgagcatgcccaacgcccagagcagcatgaagaccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcgagaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5174 - RNA, 1290 nt, synthetic construct
  misc_feature 1..1290: note = derived and/or modified CDS sequence (opt4) from SEOV(14D12)__AB618124.1__N
  source 1..1290: mol_type = other RNA
atggccaccatggaggagatccagaaggagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5175 - RNA, 1281 nt, synthetic construct
  misc_feature 1..1281: note = derived and/or modified CDS sequence (opt4) from SEOV(19CSG)__AB618114.1__N
  source 1..1281: mol_type = other RNA
atggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5176 - RNA, 1290 nt, synthetic construct
  misc_feature 1..1290: note = derived and/or modified CDS sequence (opt4) from SEOV(93HBX12)__EF192308.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcggcaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaggcctggcccagatcctgatcgaccagaaggtgaaggagatcagcaaccaggagcccatgaagctgtga

SEQ ID NO: 5177 - RNA, 1290 nt, synthetic construct
  misc_feature 1..1290: note = derived and/or modified CDS sequence (opt4) from SEOV(Cherwell)__KC626089.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatcgccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5178 - RNA, 1290 nt, synthetic construct
  misc_feature 1..1290: note = derived and/or modified CDS sequence (opt4) from SEOV(CixiRf23)__FJ803201.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggcagaaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5179 - RNA, 1290 nt, synthetic construct
  misc_feature 1..1290: note = derived and/or modified CDS sequence (opt4) from SEOV(CixiRf56)__FJ803202.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagggccagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccccctggtgcacgacatggaccccaagctgagaagcctgagccagatcctgatcgaccagaaggtgaacgagatcagcaaccaggagcccatgaagctgtga

SEQ ID NO: 5180 - RNA, 1290 nt, synthetic construct
  misc_feature 1..1290: note = derived and/or modified CDS sequence (opt4) from SEOV(CixiRn21)__FJ803205.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggacgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccacagaatcatcgtgatgttcatggtggcctggggcaaggaggccgtggacaacttccacctgggcgacgacatggaccccgagctgagaaccctggcccagatcctgatcgaccagaaggtgaaggagatcagcaaccaggagcccatgaagctgtga

SEQ ID NO: 5181 - RNA, 1290 nt, synthetic construct
  misc_feature 1..1290: note = derived and/or modified CDS sequence (opt4) from SEOV(CixiRn76)__FJ803206.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcagccagaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagggccagggcgccctggccggcatggagcccaaggagttccaggccctgagacagcacgccaaggacgccggctgcaccctggtggagcacatcgagagccccagcagcatctgggtgttcgccggcgccagagacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5182 - RNA, 1290 nt, synthetic construct
  misc_feature 1..1290: note = derived and/or modified CDS sequence (opt4) from SEOV(CUI)__GQ279395.1__N
  source 1..1290: mol_type = other RNA
atggccaccatggaggagctgcagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatgctgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacaagaagctgagaaagaagagcagcttctaccagagctacctgagaagaacccagagcatgggcatccagctggaccagagaatcatcgtgatgttcatgttcgcctggggcaaggaggccgtggacaacttccacctgggcgacgacatggaccccgagctgagaggcctggcccagatcctgatcgaccagaaggtgaaggagatcagcaaccaggagcccatgaagctgtga

SEQ ID NO: 5183 - RNA, 1290 nt, synthetic construct
  misc_feature 1..1290: note = derived and/or modified CDS sequence (opt4) from SEOV(FeixianRn1)__GU592942.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcaccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5184 - RNA, 1290 nt, synthetic construct
  misc_feature 1..1290: note = derived and/or modified CDS sequence (opt4) from SEOV(GanyuRn66)__GU592932.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcaccgccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5185 - RNA, 1290 nt, synthetic construct
  misc_feature 1..1290: note = derived and/or modified CDS sequence (opt4) from SEOV(Gongzhuling108)__KF745947.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagcgccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcctggtgtacctgaccagcttcgtggtgcccatcatcctgaaggccctgtacatgctgaccaccagaggcagacagaccagcaaggacaacaagggcatgagaatcagattcaaggacgacggcagctacgaggacgtgaacggcatcagaaagcccaagcacctgtacgtgcccatgcccaacgcccagagcagcatgaaggccgaggagatcacccccggcagattcagaaccgccgtgtgcggcctgtaccccgcccagatcaagcccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatcagagtgttcgccggcgcccccgccagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaagccagagcatgggcatccagctggaccagagaatcatcgtgatgttcatggtggccagcggcaaggaggccgtggacaacttccacctgggcgacgacatggaccccgagctgagaagcctggtgcagatcctgatcgaccagaaggtgaaggagatcagcaaccaggagcccatgaagctgtga

SEQ ID NO: 5186 - RNA, 1290 nt, synthetic construct
  misc_feature 1..1290: note = derived and/or modified CDS sequence (opt4) from SEOV(Gongzhuling147)__KF745948.1__N
  source 1..1290: mol_type = other RNA
atggccaccatggaggagatccagagagagatcagcgcccacgagggccagctggtgatcgccagacagatcgtgaaggacgccgagaagcagtacgagaaggaccccgccgacctgaacaagagagccctgcacgacagagagagcgtggccgccagcatccagagcaagatcgacgagctgaagagacacctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatcctgaccaccagcggcagacagaccagcaaggacaacaagggcatgagaatcagattcaaggacgacagcagctacgaggacgtgaacggcatcagaatgcccaagcacctgtacgtgcccatgcccaacgcccagagcagcatgaaggccgaggacatcacccccggcagattcagaaccgccgtgtgcggcctgtaccccgcccagatcaaggccagaaacatggtgagccccctgatgagcgtggtgggcttcctggccctgcccaaggactggaccagcagaatcgacgagtggctgggcgccccctgcaagttcatggccgagagccccatcgccggcagcctgagcggcaaccccgtgaacagagaccacatcagacagagacagggcgccctggccggcatggaccccaaggagttccaggccgtgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcaccatcctgcaggacatgagaaacaccatcatgcccagcaagaccgtgggcaccgccgacgagaagctgagaaagaagagcagcttctaccagagctacctgagaagaacccagagcatgggcatccagctggaccagagaatcatcgtgatcttcatggtggcctgggccaaggaggccgtggacaacttccacctgggcgacgacatggaccccgagctgagaagcctggcccagatcctgatcgaccagaaggtgaaggagatcagcaaccaggtgcccatgaagctgtga

SEQ ID NO: 5187 - RNA, 1290 nt, synthetic construct
  misc_feature 1..1290: note = derived and/or modified CDS sequence (opt4) from SEOV(Gongzhuling415)__KF745949.1__N
  source 1..1290: mol_type = other RNA
atggccaccatggaggagatccagagagagatcagcgcccacgagggccagctggtgatcgccagacagatggtgaaggacgccgagaagcagtacgagaaggacctggccgacctgaacaagagagccctgcacgacagagagagcgtggccgccagcatccagagcaagatcgacgagctgaagagacagctggccgacagaatcgccgccggcaagaacatcgagcaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatcctgaccaccagaggcagacagaccagcaaggacaacaagggcatgaccatcagattcaaggacgacagcagctacgaggacgtgaacggcatcagaatgcccaagcacctgtacgtgcccatgcccaacgcccagagcagcatgaaggccgaggacatcacccccggcagattcagaaccgccgtgtgcggcctgtaccccgcccagatcaaggccagaaacatggtgagccccctgatgagcgtggtgggcttcctggccctgcccaaggactggaccagcagaatcgacgagtggctgggcgccccctgcaagttcatggccgagagccccatcgccggcagcctgagcggcaaccccgtgaacagagaccacatcagacagagacagggcgccctggccggcatggaccccaaggagttccaggccgtgagacagcacgccaaggacgccggctgcaccctggtggagcacatcgagagccccagcagcatctgggtgttcgccggcgcccccgacagatgcctgcccacctgcctgttcgtgggcggcatggccgagctgggcgccttcttcaccatcctgcaggacatgagaaacaccatcatggccagcaagaccgtgggcaccgccgacgagaagctgggcaagaagagcagcttctaccagagctacctgagaagaacccagagcatgggcatccagctggaccagagaatcatcgtgatgttcatggtggcctgggccaaggaggccgtggacaacatccacctgggcgacgacatggaccccgagctgagaagcctggcccagatcctgatcgaccagaaggtgaaggagatcagcaaccaggtgcccatgaagctgtga

SEQ ID NO: 5188 - RNA, 1290 nt, synthetic construct
  misc_feature 1..1290: note = derived and/or modified CDS sequence (opt4) from SEOV(Gongzhuling42)__KF745942.1__N
  source 1..1290: mol_type = other RNA
atggccaccatggaggagatccagagagagatcagcgcccacgagggccagctggtgatcgccagacagaaggtgaaggacgcccagaagcagtacgagaaggaccccgacgacctgaacaagagagccctgcacgacagagagagcgtggccgccagcatccagctgaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaagggcatcagaaagcccaagcacctgtacgtgcccatgcccaacgcccagagcagcatgaaggccgaggagatcacccccggcagatgcagaaccgccgtgtgcggcctgtaccccgcccagatcaaggccagaaacatggtgagccccgtgatgagcgccgtgggcatcctggccctggccaaggactggaccagcagaatcgaggagtggctgggcaccccctgcaagttcatggccgagagccccatcgccggcagcctgagcggcaaccccgtgaacagagaccacatcagacagagacagggcgccctggccggcatggagcccaaggagttccagggcctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcgccatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctgggccaaggaggccgtggacaacttccacctgggcgacgacatggaccccgagctgagaagcctggcccagatcctgatggaccagaaggtgaaggagatcagcaaccaggagcccatgaagctgtga

SEQ ID NO: 5189 - RNA, 1290 nt, synthetic construct
  misc_feature 1..1290: note = derived and/or modified CDS sequence (opt4) from SEOV(Gongzhuling45)__KF745943.1__N
  source 1..1290: mol_type = other RNA
atggccaccatggaggagatccagagagagatcagcgcccacgagggccagctggtgatcgccagacagatggtgaaggacgccgagaagcagtacgagaaggaccccgccgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacagaaacaccctggacctgaacagcctggacatcgacgagcccaccggccagaccgccgactggctgaccatcatcgtgtacctgaccagcttcgtggtgcccatcatcctgaaggccctgtacatcctgaccaccagaggcagacagaccagcaaggacaacaagggcatgagaatcagattcaaggacgacagcagctacgaggacgtgaacggcatcagaatgcccaagcacctgtacctgcccatgcccaacgcccagagcagcatgaaggccgaggacatcacccccggcagattcagaaccgccgtgtgcggcctgtaccccgcccagatcaaggccagaaacatggtgagccccctgatgagcgtggtgggcttcctggccctgcccaaggactggaccagcagaatcgacgagtggctgggcgccccctgcaagttcatggccgagagccccatcgccggcagcctgagcggcaaccccgtgaacagagaccacatcagacagagacagggcgccctggccggcatggaccccaaggagttccaggccgtgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcaccatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctgggccaaggaggccgtggacaacttccacctgggcgacgacatggaccccgagctgagaagcctggcccagatcctgatcgaccacaaggtgaaggagatcagcaaccaggtgcccatgaagctgtga

SEQ ID NO: 5190 - RNA, 1290 nt, synthetic construct
  misc_feature 1..1290: note = derived and/or modified CDS sequence (opt4) from SEOV(Gongzhuling58)__KF745944.1__N
  source 1..1290: mol_type = other RNA
atggccaccatggaggagatccagagagagatcagcgcccacgagggccagctggtgatcgccagacagatggtgaaggacgccgagaagcagtacgagaaggaccccgccgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatcctgaccaccagaggcagacagaccagcaaggacaacaagggcatgagaatcagattcaaggacgacagcagctacgaggacgtgaacggcatcagaatgcccaagcacctgtacgtgcccatgcccaacgcccagagcagcatgaaggccgaggacatcacccccggcagattcagaaccgccgtgtgcggcctgtaccccgcccagatcaaggccagaaacatggtgagccccctgatgagcgtggtgggcttcctggccctgcccaaggactggaccagcagaatcgacgagtggctgggcgccccctgcaagttcatggccgagagccccatcgccggcagcctgagcggcaaccccgtgaacagagaccacatcagacagagacagggcgccctggccggcatggaccccaaggagttccaggccgtgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcaccatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctgggccaaggaggccgtggacaacttccacctgggcgacgacatggaccccgagctgagaagcctggcccagatcctgatcgaccagaaggtgaaggagatcagcaaccaggtgcccatgaagctgtga

SEQ ID NO: 5191 - RNA, 1290 nt, synthetic construct
  misc_feature 1..1290: note = derived and/or modified CDS sequence (opt4) from SEOV(Gongzhuling85)__KF745945.1__N
  source 1..1290: mol_type = other RNA
atggccaccatggaggagatccagagagagatcagcgcccacgagggccagctggtgatcgccagacagatggtgaaggacgccgagaagcagtacgagaaggaccccgccgacctgatcaagagagccctgcacgacagagagagcgtggccgccagcatccagagcaagatcgacgagctgaagagacagctggccgacagaatcgccgccggcaagaacatcggccaggacagagaccccaccggcctggagcccggcgaccacctgaaggagagaagcgccctgagctacggcaacaccctggacctgaacagcctggacatcgacgagcccaccggccagaccgccgactggctgaccgtgatcgtgtacctgaccagcttcgtggtgcccatcatcctgaaggccctgtacatcctgaccaccagaggcagacagaccagcaaggacaacaagggcatgagaatcagattcaaggacgtgagcagctacgaggacgtgaacggcatcagaatgcccaagcacctgtacgtgcccatgcccaacgcccagagcagcatgaaggccgaggacatcacccccggcagattcagaaccgccgtgtgcggcctgtaccccgcccagatcaaggccagaaacatggtgagccccctgatgagcgtggtgggcttcctggccctgcccaaggactggaccagcagaatcgacgagtggctgggcgccccctgcaagttcatggccgagagccccatcgccggcagcctgagcggcaaccccgtgaacagagaccacatcagacagagacagggcgccctggccggcatggaccccaaggagttccaggccgtgagacagcacgccaaggacgccggctgcaccctggtggagcacatcgagagccccagcagcatctgggtgttcgccggcgcccccgacagatgcccccccacctgcctgttcgtgagaggcatggccgagctgggcgccttcttcaccatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctgggccaaggaggccgtggacaacttccacctgggcgacgacatgcaccccgagctgagaagcctggcccagatcctgatcgaccagaaggtgaaggagatcagcaaccaggtgcccatgaagctgtga

SEQ ID NO: 5192 - RNA, 1290 nt, synthetic construct
  misc_feature 1..1290: note = derived and/or modified CDS sequence (opt4) from SEOV(Gongzhuling97)__KF745946.1__N
  source 1..1290: mol_type = other RNA
atggccaccatggaggagatccagagagagatcagcgcccacgagggccagctggtgatcgccagacagatggtgaaggacgccgagaagcagtacgagaaggaccccgccgacctgaacaagagagccctgcacgacagagagagcgtggccgccagcatccagagcaagatcgacgacctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaatgcccaagcacctgtacgtgagaatgcccaacgcccagagcagcatgaaggccgaggacatcacccccggcagattcagaaccgccgtgtgcggcctgtaccccgcccagatcaaggccagaaacatggtgagccccctgatgagcgtggtgggcttcctggccctgcccaaggactggaccagcagaatcgacgagtggctgggcgccccctgcaagttcatggccgagagccccatcgccggcagcctgagcggcaaccccgtgaacagagaccacatcagacagagacagggcgccctggccggcatggaccccaaggagttccaggccgtgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcaccatcctgcaggacatgagaatcaccatcatggccagcaagaccgtgggcaccgccgacgagaagctgagaaagaagagcagcttctaccagagctacctgagaagaacccagagcatgggcatccagctggaccagagactgatcgtgatgttcatggtggcctgggccaaggaggccgtggacaacttccacctgggcgacgacatggaccccgagctgagaagcctggcccagatcctgatcgaccagaaggtgaagcagatcagcaaccaggtgcccatgaagctgtga

SEQ ID NO: 5193 - RNA, 1290 nt, synthetic construct
  misc_feature 1..1290: note = derived and/or modified CDS sequence (opt4) from SEOV(Gou3)__AB027522.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagcttcagaaccgccgtgtgcggcctgtaccccgccaccatcaaggccagaaacatggtgagccccgtgatgagcgtggtgggcttcctggccctggccaaggactggaccagcagaatcgaggactggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccatggtggagcagatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5194 - RNA, 1290 nt, synthetic construct
  misc_feature 1..1290: note = derived and/or modified CDS sequence (opt4) from SEOV(Hb8610)__AF288643.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagagcatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaagaaggccgtggacaacttccacctgggcgacgacatggaccccgagctgagaagcctggcccagatcctgatcgaccagaaggtgaaggagatcagcaaccaggagcccatgaagctgtga

SEQ ID NO: 5195 - RNA, 1290 nt, synthetic construct
  misc_feature 1..1290: note = derived and/or modified CDS sequence (opt4) from SEOV(HuBJ16)__GQ279380.1__N
  source 1..1290: mol_type = other RNA
atggccaccatggaggagatccagagagagatcagcgcccacgagggccagctggtgatcgccagacagaaggtgaagaacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcacccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5196 - RNA, 1290 nt, synthetic construct
  misc_feature 1..1290: note = derived and/or modified CDS sequence (opt4) from SEOV(HuBJ22)__GQ279379.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcacccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5197 - RNA, 1290 nt, synthetic construct
  misc_feature 1..1290: note = derived and/or modified CDS sequence (opt4) from SEOV(HuBJ3)__GQ279391.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggtgaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcagattcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgagggctgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5198 - RNA, 1290 nt, synthetic construct
  misc_feature 1..1290: note = derived and/or modified CDS sequence (opt4) from SEOV(K24-e7)__AF288653.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacttcaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5199 - RNA, 1290 nt, synthetic construct
  misc_feature 1..1290: note = derived and/or modified CDS sequence (opt4) from SEOV(K24-v2)__AF288655.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacttcaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagacacacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5200 - RNA, 1290 nt, synthetic construct
  misc_feature 1..1290: note = derived and/or modified CDS sequence (opt4) from SEOV(OuhaiRf35)__FJ803208.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgccagagacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5201 - RNA, 1290 nt, synthetic construct
  misc_feature 1..1290: note = derived and/or modified CDS sequence (opt4) from SEOV(OuhaiRn146)__FJ803210.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagggccagggcgccctggccggcatggagcccaaggagttccaggccctgagacagcacgccaaggacgccggctgcaccctggtggagcacatcgagagccccagcagcatctgggtgttcgccggcgccagagacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5202 - RNA, 1290 nt, synthetic construct
  misc_feature 1..1290: note = derived and/or modified CDS sequence (opt4) from SEOV(Pf26)__AY006465.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcgtgcagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaagcccagaaacatggtgagccccgtgatcagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5203 - RNA, 1290 nt, synthetic construct
  misc_feature 1..1290: note = derived and/or modified CDS sequence (opt4) from SEOV(Rn-CP7)__GQ279382.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaagcatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5204 - RNA, 1290 nt, synthetic construct
  misc_feature 1..1290: note = derived and/or modified CDS sequence (opt4) from SEOV(Rn-DC8)__GQ279386.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccgccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaagcatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5205 - RNA, 1290 nt, synthetic construct
  misc_feature 1..1290: note = derived and/or modified CDS sequence (opt4) from SEOV(Rn-M11)__GQ279383.1__N
  source 1..1290: mol_type = other RNA
atggccaccatggaggagatccagagagagatcagcgcccacgagggccagctggtgatcgccagacagaaggtgaagaacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaagcatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagaagaggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5206 - RNA, 1290 nt, synthetic construct
  misc_feature 1..1290: note = derived and/or modified CDS sequence (opt4) from SEOV(RuianRf74)__FJ803213.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaatggccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatcgaccccgagctgagaagcctggcccagatcctgatcgaccagaaggtgaaggagatcagcaaccaggagcccatgaagctgtga

SEQ ID NO: 5207 - RNA, 1290 nt, synthetic construct
  misc_feature 1..1290: note = derived and/or modified CDS sequence (opt4) from SEOV(RuianRn23)__FJ803214.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcaaggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5208 - RNA, 1290 nt, synthetic construct
  misc_feature 1..1290: note = derived and/or modified CDS sequence (opt4) from SEOV(RuianRn33)__FJ803215.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggccagaggcaaggaggccatgtacaacctgcacctgagagacgacatgaccccccagctgctgctgctggtgcagatcctgctggaccaccaggtgaaggagatcagcaaccaggagctgatgaagctgtga

SEQ ID NO: 5209 - RNA, 1290 nt, synthetic construct
  misc_feature 1..1290: note = derived and/or modified CDS sequence (opt4) from SEOV(SC106)__GU361893.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgcccatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5210 - RNA, 1290 nt, synthetic construct
  misc_feature 1..1290: note = derived and/or modified CDS sequence (opt4) from SEOV(SEO/Belgium/Rn895/2005)__JQ898106.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgacagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5211 - RNA, 1290 nt, synthetic construct
  misc_feature 1..1290: note = derived and/or modified CDS sequence (opt4) from SEOV(Taonan420)__KF745951.1__N
  source 1..1290: mol_type = other RNA
atggccaccatggaggagatccagagagagatcagcgcccacgagggccagctggtgatcgccagacagaacgtgaaggacgccgagaagcagtacgagaaggaccccgacgacctgaacaagagagccctgcacgacagagagagcgtggccgccagcatccagagcaagatcgacgagctgaagagacagcccgccgacagaatcgccgccggcaagaacatcggccaggacagagaccccaccggcgtggagcccggcgaccacctgaaggagagaagcgccctgagctacggcaacaccctggacctgaacagactggacatcgacgagcccaccggccagagagccgactggctgaccatcatcgtgtacctgaccagcttcgtggtgagaatcatcctgaaggccctgtacatgttcagcaccagaggcagacagaccagcaaggacaacaagggcctgagaatcagattcaaggacgacagcagctacgaggacttcaacggcatcagaaagcccaagcacctgtacgtgcccatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccgccatggagcccaaggagttccaggccctgagacagcacgccaaggaccccggctgcaccctggtggagcacatcgagagccccagcagcatctgggtgagcgccggcgcccccgacagatgcccccccacctgcctgttcgtgggcggcatggccgagctgggcgccttcttcagcatcttccaggacatgagaaacaccatcatgcccagcaagaccgtgggcaccgccgacgagaagctgagaaagaagagcctgttctaccagagctacctgagaagaacccagagcatgggcatccagctggaccagagaatcatcgtgatgttcatggtggcctggggcaaggaggccgtggacaacttccacctgcccgacgacatggaccccgagctgagaagcctggcccagatcctgatcgtgcagaaggtgaaggagatcagcaaccaggagcccatgaagctgtga

SEQ ID NO: 5212 - RNA, 1290 nt, synthetic construct
  misc_feature 1..1290: note = derived and/or modified CDS sequence (opt4) from SEOV(Taonan52)__KF745950.1__N
  source 1..1290: mol_type = other RNA
atggccaccatggaggagatccagagagagatcagcgcccacgagggccagctggtgaccgccagacagaaggtgaaggacgccgagaagcagtacgagaaggaccccgacgacctgaacaagagagccctgcacgacagagagagcgtggccgccagcatccagagcaagatcgacgaggtgaagagacagctggccgacagaatcgccgccggcaagaacatcggccaggacagagaccccaccggcgtggagcccggcgaccaccccaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgagcaccaccagaggcagacagaccagcaaggacaacagaggcatgagaatcagattccaggacgacagcagctacgaggacgtgaacggcatcagaaagcccaagcacctgtacgtgcccatgcccaacgcccagagcagcatgaaggccgaggaggtgacccccggcagattcagaaccgccgtgtgcggcctgtaccccgcccagatcaaggccagaaacatggtgagacccgtgatgagcgtggtgggcttcctggccctggccaaggcctggaccagcagaatcgaggagtggctgggcgccccctgcaagttcatggccgagagccccatcgccggcagcctgagcggcaaccccgtgtacagagactacatcagacagagacagggcgccctggccggcatggagcccaaggagttccaggccctgagacagcacgccaaggacgccggctgcaccctggtggagctgatcgagagccccagcagcatcagcgtgttcgccggcgcccccgacagatgccccagaacctgcctgttcgtgggcggcatggccgagctgggcgccaacttcagcatgctgcaggacatgagcaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggccagcggcaaggaggccgtggactacttccacctgggcgacgacatggaccccgagctgagaagcctggcccccatcctgatcgaccagaaggtgaaggagatcagcaaccaggagcccatgaagctgtga

SEQ ID NO: 5213 - RNA, 1290 nt, synthetic construct
  misc_feature 1..1290: note = derived and/or modified CDS sequence (opt4) from SEOV(WuhanMm24)__JQ665911.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgccgccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccggcctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5214 - RNA, 1290 nt, synthetic construct
  misc_feature 1..1290: note = derived and/or modified CDS sequence (opt4) from SEOV(WuhanRf02)__JQ665912.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctggaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagagacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgccagagacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5215 - RNA, 1290 nt, synthetic construct
  misc_feature 1..1290: note = derived and/or modified CDS sequence (opt4) from SEOV(WuhanRf07)__JQ665913.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgccagagacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5216 - RNA, 1290 nt, synthetic construct
  misc_feature 1..1290: note = derived and/or modified CDS sequence (opt4) from SEOV(ZJ5)__FJ753400.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaacctggtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatcgtggcctggggcaaggaggccgtggacaacttccacctgggcgacgacctggaccccgagctgagaagcctggcccagatcctgatcgaccagaaggtgaaggagatcagcaaccaggagcccatgaagctgtga

SEQ ID NO: 5217 - RNA, 1290 nt, synthetic construct
  misc_feature 1..1290: note = derived and/or modified CDS sequence (opt4) from SEOV(ZT10)__AY766368.1__N
  source 1..1290: mol_type = other RNA
atggccctgtgcgaggagatccagagagagatcagcgcccacgagggccagctggtgatcgccagacagaaggtgaaggacgccgagaagcagtacgagaaggaccccgacgacttcaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcggcctggccgacatgagaaacaccatcatggccagcaagaccgagggcaccgccgacgagaagctgagaaagaagagcagcttctaccagagctacctgagaagacagcagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5218 - RNA, 1290 nt, synthetic construct
  misc_feature 1..1290: note = derived and/or modified CDS sequence (opt4) from SEOV(ZT71)__AY750171.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacttcaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgagggcaccgccgacgagaagctgagaaagaagagcagcttctaccagagctacctgagaagacagcagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5219 - RNA, 1290 nt, synthetic construct
  misc_feature 1..1290: note = derived and/or modified CDS sequence (opt4) from SEOV(zy27)__AF406965.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacagcaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgcccccagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccgagagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagaccacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5220 - RNA, 1290 nt, synthetic construct
  misc_feature 1..1290: note = derived and/or modified CDS sequence (opt4) from SEOV(DN2)__KX289954.1__N
  source 1..1290: mol_type = other RNA
atggccaccatggaggagatccagagagagatcagcgcccacgagggccagctggtgatcgccagacagaaggccaaggacgccgagaagcagtacgagaaggaccccgacgacctgaacaagagagccctgcacgacagaggcagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgagccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgtgttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5221 - RNA, 1290 nt, synthetic construct
  misc_feature 1..1290: note = derived and/or modified CDS sequence (opt4) from SEOV(IR162)__KX079476.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctggacaccccctgcaagttcatggtggagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5222 - RNA, 1290 nt, synthetic construct
  misc_feature 1..1290: note = derived and/or modified CDS sequence (opt4) from SEOV(Gou3)__AF184988.1__N
  source 1..1290: mol_type = other RNA
atggccaccatggaggagatccagagagagatcagcgcccacgagggccagctggtgatcgccagaagaaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggactggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcttcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5223 - RNA, 1290 nt, synthetic construct
  misc_feature 1..1290: note = derived and/or modified CDS sequence (opt4) from SEOV(Gou3-v9)__AF288651.1__N
  source 1..1290: mol_type = other RNA
atggccaccaaggaggagatccagagagagatcagcgcccacgagggccagctggtgatcgccagacagaaggtgaaggacgccgagaagcagtacgagaaggaccccgacgtgctgaacaagagagccctgcacgacagagagagcgtggccgccagcatccagagcaagatcgacgagctgaagagacagctggccgacagaatcgccgccggcaagagcatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacagaggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggactggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5224 - RNA, 1290 nt, synthetic construct
  misc_feature 1..1290: note = derived and/or modified CDS sequence (opt4) from SEOV(IR461)__AF329388.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatcagaatcagattcaaggacgacagcagctacgagaacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccggcaacatggtgagccccgtgatgagcgtggtgggcttcctggccctggccaaggactggaccagcagaatcgaggagtggctggacaccccctgcaagttcatggtggagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5225 - RNA, 1290 nt, synthetic construct
  misc_feature 1..1290: note = derived and/or modified CDS sequence (opt4) from SEOV(JUN5-14)__DQ217791.1__N
  source 1..1290: mol_type = other RNA
atggccaccatggaggagttccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5226 - RNA, 1290 nt, synthetic construct
  misc_feature 1..1290: note = derived and/or modified CDS sequence (opt4) from SEOV(L99)__AF488708.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagaaccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5227 - RNA, 1290 nt, synthetic construct
  misc_feature 1..1290: note = derived and/or modified CDS sequence (opt4) from SEOV(R22)__AF488707.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcagaatggccgagctgggcgccttcttcagcatcctgcaggacatgaagaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5228 - RNA, 1290 nt, synthetic construct
  misc_feature 1..1290: note = derived and/or modified CDS sequence (opt4) from SEOV(TURCKHEIM/Hu/FRA/2016/2016.00044)__KX064270.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctggacgccccctgcaagttcatcgccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5229 - RNA, 1290 nt, synthetic construct
  misc_feature 1..1290: note = derived and/or modified CDS sequence (opt4) from SEOV(Z37)__AF187082.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacttcaacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacgccaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcggcatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5230 - RNA, 1290 nt, synthetic construct
  misc_feature 1..1290: note = derived and/or modified CDS sequence (opt4) from SEOV(Tchoupitoulas (TCH))__AF329389.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacttctacaagagagccctgcacgacagagagagcgtggccgccagcatccagagcaagatcgacgagctgaagagacagctggccgacagaatcgccgccggcaagaacatcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagccccatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5231 - RNA, 1290 nt, synthetic construct
  misc_feature 1..1290: note = derived and/or modified CDS sequence (opt4) from SEOV__M34881.1__N
  source 1..1290: mol_type = other RNA
atggccaccatggaggagatccagagagagatcagcgcccacgagggccagctggtgatcgccagacagaaggtgaaggacgccgagaagcagtacgagaaggaccccgacgacctgaacaagagagccctgcacgacagagagagcgtggccgccagcatccagagcaagatcgacgagctgaagagacagctggccgacagactgcagcagggcagaaccagcggccaggacagagaccccaccggcgtggagcccggcgaccacctgaaggagagaagcgccctgagctacggcaacaccctggacctgaacagcctggacatcgacgagcccaccggccagaccgccgactggctgaccatcatcgtgtacctgaccagcttcgtggtgcccatcatcctgaaggccctgtacatgctgaccaccagaggcagacagaccagcaaggacaacaagggcatgagaatcagattcaaggacgacagcagctacgaggacgtgaacggcatcagaaagcccaagcacctgtacgtgagcatgcccaacgcccagagcagcatgaaggccgaggagatcacccccggcagattcagaaccgccgtgtgcggcctgtaccccgcccagatcaaggccagaaacatggtgagccccgtgatgagcgtggtgggcttcctggccctggccaaggactggaccagcagaatcgaggagtggctgggcgccccctgcaagttcatggccgagagcctgatcgccggcagcctgagcggcaaccccgtgaacagagactacatcagacagagacagggcgccctggccggcatggagcccaaggagttccaggccctgagacagcacagcaaggacgccggctgcaccctggtggagcacatcgagagccccagcagcatctgggtgttcgccggcgcccccgacagatgcccccccacctgcctgttcgtgggcggcatggccgagctgggcgccttcttcagcatcctgcaggacatgagaaacaccatcatggccagcaagaccgtgggcaccgccgacgagaagctgagaaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaagcctggcccagatcctgatcgaccagaaggtgaaggagatcagcaaccaggagcccatgaagctgtga

SEQ ID NO: 5232 - RNA, 1287 nt, synthetic construct
  misc_feature 1..1287: note = derived and/or modified CDS sequence (opt4) from SNV(H10)__NC_005216.1__N
  source 1..1287: mol_type = other RNA
atgagcaccctgaaggaggtgcaggacaacatcaccctgcacgagcagcagctggtgaccgccagacagaagctgaaggacgccgagagagccgtggagctggaccccgacgacgtgaacaagagcaccctgcagagcagaagagccgccgtgagcgccctggagaccaagctgggcgagctgaagagagagctggccgacctgatcgccgcccagaagctggccagcaagcccgtggaccccaccggcatcgagcccgacgaccacctgaaggagaagagcagcctgagatacggcaacgtgctggacgtgaacagcatcgacctggaggagcccagcggccagaccgccgactggaagagcatcggcctgtacatcctgagcttcgccctgcccatcatcctgaaggccctgtacatgctgagcaccagaggcagacagaccatcaaggagaacaagggcaccagaatcagattcaaggacgacagcagctacgaggaggtgaacggcatcagaaagcccagacacctgtacgtgagcatgcccaccgcccagagcaccatgaaggccgacgagatcacccccggcagattcagaaccatcgcctgcggcctgttccccgcccaggtgaaggccagaaacatcatcagccccgtgatgggcgtgatcggcttcagcttcttcgtgaaggactggatggagagaatcgacgacttcctggccgccagatgccccttcctgcccgagcagaaggaccccagagacgccgccctggccaccaacagagcctacttcatcaccagacagctgcaggtggacgagagcaaggtgagcgacatcgaggacctgatcgccgacgccagagccgagagcgccaccatcttcgccgacatcgccaccccccacagcgtgtgggtgttcgcctgcgcccccgacagatgcccccccaccgccctgtacgtggccggcatgcccgagctgggcgccttcttcgccatcctgcaggacatgagaaacaccatcatggccagcaagagcgtgggcaccagcgaggagaagctgaagaagaagagcgccttctaccagagctacctgagaagaacccagagcatgggcatccagctggaccagaagatcatcatcctgtacatgagccactggggcagagaggccgtgaaccacttccacctgggcgacgacatggaccccgagctgagagagctggcccagaccctggtggacatcaaggtgagagagatcagcaaccaggagcccctgaagctgtga

SEQ ID NO: 5233 - RNA, 1287 nt, synthetic construct
  misc_feature 1..1287: note = derived and/or modified CDS sequence (opt4) from SNV(2)__JQ690282.1__N
  source 1..1287: mol_type = other RNA
atgagcaccctgaaggaggtgcaggacaacatcaccctgcacgagcagcagctggtgaccgccagacagaagctgaaggacgccgagagagccgtggagctggaccccgacgacgtgaacaagagcaccctgcagagcagaagagccgccgtgagcgccctggagaccaagctgggcgagctgaagagagagctggccgacctgatcgccgcccagaagctggccagcaagcccgtggaccccaccggcatcgagcccgacgaccacctgaaggagaagagcagcctgagatacggcaacgtgctggacgtgaacagcatcgacctggaggagcccagcggccagaccgccgactggaagagcatcggcctgtacatcctgagcttcgccctgcccatcatcctgaaggccctgtacatgctgagcaccagaggcagacagaccatcaaggagaacaagggcaccagaatcagattcaaggacgacagcagctacgaggaggtgaacggcatcagaaagcccagacacctgtacgtgagcatgcccaccgcccagagcaccatgaaggccgacgagatcacccccggcagattcagaaccatcgcctgcggcctgttccccgcccaggtgaaggccagaaacatcatcagccccgtgatgggcgtgatcggcttcagcttcttcgtgaaggactggatggagagaatcgacgacttcctggccgccagatgccccttcctgcccgagcagaaggaccccagagacgccgccctggccaccaacagagcctacttcatcaccagacagatgcaggtggacgagagcaaggtgagcgacatcgaggacctgatcgccgacgccagagccgagagcgccaccatcttcgccgacatcgccaccccccacagcgtgtgggtgttcgcctgcgcccccgacagatgcccccccaccgccctgtacgtggccggcatgcccgagctgggcgccttcttcgccatcctgcaggacatgagaaacaccatcatggccagcaagagcgtgggcaccagcgaggagaagctgaagaagaagagcgccttctaccagagctacctgagaagaacccagagcatgggcatccagctggaccagaagatcatcatcctgtacatgagccactggggcagagaggccgtgaaccacttccacctgggcgacgacatggaccccgagctgagagagctggcccagaccctggtggacatcaaggtgagagagatcagcaaccaggagcccctgaagctgtga

SEQ ID NO: 5234 - RNA, 1287 nt, synthetic construct
  misc_feature 1..1287: note = derived and/or modified CDS sequence (opt4) from SNV(3)__JQ690278.1__N
  source 1..1287: mol_type = other RNA
atgagcaccctgaaggaggtgcaggacaacatcaccctgcacgagcagcagctggtgaccgccagacagaagctgaaggacgccgagagagccgtggagctggaccccgacgacgtgaacaagagcaccctgcagagcagaagagccgccgtgagcgccctggagaccaagctgggcgagctgaagagagagctggccgacctgatcgccgcccagaagctggccagcaagcccgtggaccccaccggcatcgagcccgacgaccacctgaaggagaagagcagcctgagatacggcaacgtgctggacgtgaacagcatcgacctggaggagcccagcggccagaccgccgactggaagagcatcggcctgtacatcctgagcttcgccctgcccatcatcctgaaggccctgtacatgctgagcaccagaggcagacagaccatcaaggagaacaagggcaccagaatcagattcaaggacgacagcagctacgaggaggtgaacggcatcagaaagcccagacacctgtacgtgagcatgcccaccgcccagagcaccatgaaggccgacgagatcacccccggcagattcagaaccatcgcctgcggcctgttccccgcccaggtgaaggccagaaacatcatcagccccgtgatgggcgtgatcggcttcagcttcttcgtgaaggactggatggagagaatcgacgacttcctggccgccagatgccccttcctgcccgagcagaaggaccccagagacgccgccctggccaccaacagagcctacttcatcaccagacagctgcaggtggacgagagcaaggtgagcgacatcgaggacctgatcgccgacgccagagccgagagcgccaccatcttcgccgacatcgccaccccccacagcgtgtgggtgttcgcctgcgcccccgacagatgcccccccaccgccctgtacgtggccggcatgcccgagctgggcgccttcttcgccatcctgcaggacatgagaaacaccatcatggccagcaagagcgtgggcaccagcgaggagaagctgaagaagaagagcgccttctaccagagctacctgagaagaacccagagcatgggcatccagcccgaccagaagatcatcatcctgtacatgagccactggggcagagaggccgtgaaccacttccacctgggcgacgacatggaccccgagctgagagagctggcccagaccctggtggacatcaaggtgagagagatcagcaaccaggagcccctgaagctgtga

SEQ ID NO: 5235 - RNA, 1287 nt, synthetic construct
  misc_feature 1..1287: note = derived and/or modified CDS sequence (opt4) from SNV(CC107/POR)__KT885046.1__N
  source 1..1287: mol_type = other RNA
atgagcaccctgaaggaggtgcaggacaacatcaccctgcacgagcagcagctggtgaccaccagacagaagctgaaggacgccgagagagccgtggagctggaccccgacgacgtgaacaagagcaccctgcagagcagaagagccgccgtgagcgccctggagaccaagctgggcgagctgaagagagagctggccgacctgatcgccgcccagaagctggccagcaagcccgtggaccccaccggcatcgagcccgacgaccacctgaaggagaagagcagcctgagatacggcaacgtgctggacgtgaacagcatcgacctggaggagcccagcggccagaccgccgactggaagagcatcggcctgtacatcctgagcttcgccctgcccatcatcctgaaggccctgtacatgctgagcaccagaggcagacagaccatcaaggagaacaagggcaccagaatcagattcaaggacgacagcagctacgaggaggtgaacggcatcagaaagcccagacacctgtacgtgagcatgcccaccgcccagagcaccatgaaggccgacgagatcacccccggcagattcagaaccatcgcctgcggcctgttccccgcccaggtgaaggccagaaacatcatcagccccgtgatgggcgtgatcggcttcagcttcttcgtgaaggactggatggagagaatcgacgagttcctggccgccagatgccccttcctgcccgagcagaaggaccccagagacgccgccctggccaccaacagagcctacttcatcaccagacagatgcaggtggacgagagcaaggtgagcgacatcgaggacctgatcgccgacgccagagccgagagcgccaccatcttcgccgacatcgccaccccccacagcgtgtgggtgttcgcctgcgcccccgacagatgcccccccaccgccctgtacgtggccggcatgcccgagctgggcgccttcttcgccatcctgcaggacatgagaaacaccatcatggccagcaagagcgtgggcaccagcgaggagaagctgaagaagaagagcgccttctaccagagctacctgagaagaacccagagcatgggcatccagctggaccagaagatcatcatcctgtacatgagccactggggcagagaggccgtgaaccacttccacctgggcgacgacatggaccccgagctgagagagctggcccagaccctggtggacatcaaggtgagagagatcagcaaccaggagcccctgaagctgtga

SEQ ID NO: 5236 - RNA, 1287 nt, synthetic construct
  misc_feature 1..1287: note = derived and/or modified CDS sequence (opt4) from HPS(Convict Creek 107)__L33683.1__N
  source 1..1287: mol_type = other RNA
atgagcaccctgaaggaggtgcaggacaacatcaccctgcacgagcagcagctggtgaccaccagacagaagctgaaggacgccgagagagccgtggagctggaccccgacgacgtgaacaagagcaccctgcagagcagaagagccgccgtgagcgccctggagaccaagctgggcgagctgaagagagagctggccgacctgatcgccgcccagaagctggccagcaagcccgtggaccccaccggcatcgagcccgacgaccacctgaaggagaagagcagcctgagatacggcaacgtgctggacgtgaacagcatcgacctggaggagcccagcggccagaccgccgactggaagagcatcggcctgtacatcctgagcttcgccctgcccatcatcctgaaggccctgtacatgctgagcaccagaggcagacagaccatcaaggagaacaagggcaccagaatcagattcaaggacgacagcagctacgaggaggtgaacggcatcagaaagcccagacacctgtacgtgagcatgcccaccgcccagagcaccatgaaggccgacgagatcacccccggcagattcagaaccatcgcctgcggcctgttccccgcccaggtgaaggccagaaacatcatcagccccgtgatgggcgtgatcggcttcagcttcttcgtgaaggactggatggagagaatcgacgagttcctggccgccagatgccccttcctgcccgagcagaaggaccccagagacgccgccctggccaccaacagagcctacttcatcaccagacagatgcaggtggacgagagcaaggtgagcgacatcgaggacctgatcgccgacgccagagccgagagcgccaccatcttcgccgacatcgccaccccccacagcgtgtgggtgttcgcctgcgcccccgacagatgcccccccaccgccctgtacgtggccggcatgcccgagctgggcgccttcttcggcatcctgcaggacatgagaaacaccatcatggccagcaagagcgtgggcaccagcgaggagaagctgaagaagaagagcgccttctaccagagctacctgagaagaacccagagcatgggcatccagctggaccagaagatcatcatcctgtacatgagccactggggcagagaggccgtgaaccacttccacctgggcgacgacatggaccccgagctgagagagctggcccagaccctggtggacatcaaggtgagagagatcagcaaccaggagcccctgaagctgtga

SEQ ID NO: 5237 - RNA, 1287 nt, synthetic construct
  misc_feature 1..1287: note = derived and/or modified CDS sequence (opt4) from HPS(Convict Creek 74)__L33816.1__N
  source 1..1287: mol_type = other RNA
atgagcaccctgaaggaggtgcaggacaacatcaccctgcacgagcagcagctggtgaccagcagacagaagctgaaggacgccgagagagccgtggagctggaccccgacgacgtgaacaagagcaccctgcagagcagaagagccgccgtgagcgccctggagaccaagctgggcgagctgaagagagagctggccgaccacatcgccgcccagaagctggccagcaagcccgtggaccccaccggcatcgagcccgacgaccacctgaaggagaagagcagcctgagatacggcaacgtgctggacgtgaacagcatcgacctggaggagcccaacggccagaccgccgactggaagagcatcggcctgtacatcctgagcttcgccctgcccatcatcctgaaggccctgtacatgctgagcaccagaggcagacagaccatcaaggagaacaagggcaccagaatcagattcaaggacgacagcagctacgaggaggtgaacggcatcagaaagcccagacacctgtacgtgagcatgcccaccgcccagagcaccatgaaggccgacgagatcacccccggcagattcagaaccatcgcctgcggcctgttccccgcccaggtgaaggccagaaacatcatcagccccgtgatgggcgtgatcggcttcagcttcttcgtgaaggactggatggagagaatcgacgagttcctggccgccagatgccccttcctgcccgagcagaaggaccccagagacgccgccctggccaccaacagagcctacttcatcaccagacagctgcaggtggacgagagcaaggtgagcgacatcgaggacctgatcgccgacgccagagccgagagcgccaccatcttcgccgacatcgccaccccccacagcgtgtgggtgttcgcctgcgcccccgacagatgcccccccaccgccctgtacgtggccggcatgcccgagctgggcgccttcttcggcatcctgcaggacatgagaaacaccatcatggccagcaagagcgtgggcaccagcgaggagaagctgaagaagaagagcgccttctaccagagctacctgagaagaacccagagcatgggcatccagctggaccagaagatcatcatcctgtacatgagccactggggcagagaggccgtgaaccacttccacctgggcgacgacatggaccccgagctgagagagctggcccagaccctggtggacatcaaggtgagagagatcagcaaccaggagcccctgaagctgtga

SEQ ID NO: 5238 - RNA, 1287 nt, synthetic construct
  misc_feature 1..1287: note = derived and/or modified CDS sequence (opt4) from HPS(H-NY1)__U47135.1__N
  source 1..1287: mol_type = other RNA
atgagcaccctgaaggaggtgcaggacaacatcaccctgcacgagcagcagctggtgaccgccagacagaagctgaaggacgccgagaaggccgtggaggtggaccccgacgacgtgaacaagagcaccctgcagggcagaagagccgccgtgagcgccctggagaccaagctgggcgagctgaagagacagctggccgacctgatcgccgcccagaagctggccagcaagcccatcgaccccaccggcatcgagcccgacgaccacctgaaggagaagagcagcctgagatacggcaacgtgctggacgtgaacagcatcgacctggaggagcccagcggccagaccgccgactggaaggccatcggcatgtacatcctgagcttcgccatccccatcatcctgaaggccctgtacatgctgagcaccagaggcagacagaccgtgaaggagaacaagggcaccagaatcagattcaaggacgacagcagctacgaggaggtgaacggcatcagaaagcccagacacctgtacgtgagcatgcccaccgcccagagcaccatgaaggccgacgagatcacccccggcagattcagaaccatcgcctgcggcctgttccccgcccaggtgaaggccagaaacatcatcagccccgtgatgggcgtgatcggcttcaacttcttcgtgaaggactggatggacagaatcgacgacttcctggccgagagatgccccttcctgcccgagcccagagaccccaaggacgccgccctgggcaccaacagagcctacttcatcaccagacaggcccaggtggacgagagcaaggtggtggacatcgaggagctgatcgtggacgccagagccgagagcgccaccctgttcaccgacatcgccaccccccacagcgtgtgggtgttcgcctgcgcccccgacagatgcccccccaccgccctgtacgtggccggcatgcccgagctgggcgccttcttcgccatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgatccactggggcaaggaggccgtgaaccacttccacctgggcgacgacatggaccccgagctgagagagctggcccaggccctggtggacgccaaggtgaaggagatcagcaaccaggagcccctgaagctgtga

SEQ ID NO: 5239 - RNA, 1290 nt, synthetic construct
  misc_feature 1..1290: note = derived and/or modified CDS sequence (opt4) from THAIV(Nakhon Ratchasima/Bi0017/2004)__AM397664.1__N
  source 1..1290: mol_type = other RNA
atggccaccatggaggagctgcagagagagatcaacgcccacgagggccagctggtggtggccagacagaaggtgaaggacgccgagaagcagtacgagaaggaccccgacgacctgaacagaagagccctgcacgacagagagagcgtggccgccagcatccagagcaagatcgacgagctgaagagacagctggccgacagaatcgccagcggcagaaccatcggccaggacagagaccccaccggcgtggagcccggcgaccacctgagagagagaagcatgctgagctacggcaacgtgctggacctgaacaacctggacatcgaggagcccaccggccagaccgccgactggctgaccatcatcgtgtacctgaccagcttcgtgatccccatcatcctgaaggccctgtacatgctgaccaccagaggcagacagaccaccaaggacaacaagggcatgagaatcagattcaaggacgacagcagctacgaggacgtgaacggcatcagaaagcccaagcacctgtacatcagcatgcccaacgcccagagcagcatgaaggccgaggagatcacccccggcagattcagaaccgccgtgtgcggcctgtaccccgcccaggtgaaggccagaaacatggtgagccccgtgatgagcgtgatcggcttcatggccctggccaaggactggaccgacagaatccaggactggctgggcgccccctgcaagttcctgcccgacctgagcacccagagcctgcacgccagcccccccaccaacgccgactacatcgcccagagacagggcctgctggccggcatggagaccaaggagagcaagggcatcagagaccacgccagagacgccggctgcaccctggtggaccacctggacagccccagcagcatctgggtgttcgccggcgcccccgacagatgcccccccacctgcctgttcatcgccggcatggccgagctgggcgccttcttcagcatcctgcaggacatgagaaacaccatcatggccagcaagaccgtgggcaccagcgaggagaagctgaagaagaagagcagcttctaccagagctacctgagaagaacccagagcatgggcatccagctggaccagagaatcatcgtgatgttcatggtggcctggggcaaggaggccgtggacaacttccacctgggcgacgacatggaccccgagctgagaaacctggcccagctgctgatcgaccagaaggtgaaggagatcagcaaccaggagcccctgaagctgtga

SEQ ID NO: 5240 - RNA, 1290 nt, synthetic construct
  misc_feature 1..1290: note = derived and/or modified CDS sequence (opt4) from TULV(Tula/Moravia/5302Ma/94)__NC_005227.2__N
  source 1..1290: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcaccggcttcgccctggccatcatcctgaaggccctgtacatgctgagcaccagaggcagacagaccatcaaggagaacaagggcaccagaatcagattcaaggacgacagcagctacgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgagaagatcgaggagttcctgatcaagccctgccccttcctgaagaagagcggccccagcaaggaggaggacttcctggtgagcaacgacgcctacctgctgggcagagagaaggccctgagagagagccacctggccgagatcgacgacctgatcgacctggccgccagcggcgaccccaccccccccgacagcatcaagagcccccaggccccctgggtgttcgcctgcagacccgacagatgcccccccacctgcatctacatcgccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgaccgagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5241 - RNA, 1293 nt, synthetic construct
  misc_feature 1..1293: note = derived and/or modified CDS sequence (opt4) from TULV(D17-98)__AF289820.1__N
  source 1..1293: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcatcggcttcgccctggccatcgtgctgaaggccctgtacatgctgagcaccagaggcagacagaccatcaaggagaacaagggcaccagaatcagattcaaggacgacagcagctacgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgacaagatcgaggagttcctgatcaagccctgccccttcctgaagaagcagggcggccccaacaaggacgaggagttcctggtgagctacgacgcctacctgctgggcagagagaaggccctgagagagagccacctggccgagatcgacgacctgatcgacctggccgccagcggcgaccccaccccccccgacagcatcaagagcccccagggcccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgatggagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5242 - RNA, 1293 nt, synthetic construct
  misc_feature 1..1293: note = derived and/or modified CDS sequence (opt4) from TULV(D5-98)__AF289819.1__N
  source 1..1293: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcatcggcttcgccctggccatcgtgctgaaggccctgtacatgctgagcaccagaggcagacagaccatcaaggagaacaagggcaccagaatcagattcaaggacgacagcagctacgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgacaagatcgaggagttcctgatcaagccctgccccttcctgaagaagcagggcggccccaacaaggacgaggagttcctggtgagctacgacgcctacctgctgggcagagagaaggccctgagagagagccacctggccgagatcgacgacctgatcgacctggccgccagcggcgaccccaccccccccgacagcatcaagagcccccaggccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgatggagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5243 - RNA, 1293 nt, synthetic construct
  misc_feature 1..1293: note = derived and/or modified CDS sequence (opt4) from TULV(D63-98)__AF289821.1__N
  source 1..1293: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcatcggcttcgccctggccatcgtgctgaaggccctgtacatgctgagcaccagaggcagacagaccatcaaggagaacaagggcaccagaatcagattcaaggacgacagcagctacgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgacaagaaggaggagttcctgatcaagccctgccccttcctgaagaagcagggcggccccaacaaggacgaggagttcctggtgagcaacgacgcctacctgctgggcagagagaaggccctgagagagagccacctggccgagatcgacgacctgatcgacctggccgccagcggcgaccccaccccccccgacagcatcaagagcccccagggcccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgatggagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5244 - RNA, 1290 nt, synthetic construct
  misc_feature 1..1290: note = derived and/or modified CDS sequence (opt4) from TULV(MG23/Omsk)__AF442621.1__N
  source 1..1290: mol_type = other RNA
atgagcaccctgaaggagatccaggaggagatcaccagacacgagcagcagatcgtgatcgccagacagaagctgaaggacgccgagaagaccgtggaggccgaccccgacgacgtgaacaagaacaccctgcagagcagaagagccgccgtgagcaccctggaggacaagctggccgagttcaagagacagctggccgacctggtgagcagccagaagatgggcgagaagcccgtggaccccaccggcctggagcccgacgaccacctgaaggagagaagcagcctgagatacggcaacgtgctggacgtgaacgccaccgacatcgacgagcccagcggccagaccgccgactggttcagcatcggccagtacatcatgggcttcgccctggccatcgtgctgaaggccctgtacatgctgagcaccagaggcagacagaccatcaaggagaacaagggcaccagaatcaagttcaaggacgacagcagcatcgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgacaagatcgaggagttcctgatcaagccctgccccttcctgaagaagcagggcagcaccaaggaggaggagttcctggtgagcaacgacgcctacatgctgggcagagagaaggccctgagagagagccacctggccgagatcgacgagctgatcgacctggccgacagcggcgaccccaccccccccgacagcatcaagagcccccaggccccctgggtgttcgcctgcgcccccgacagatgcccccccacctgcatctacatcgccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgatggagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5245 - RNA, 1290 nt, synthetic construct
  misc_feature 1..1290: note = derived and/or modified CDS sequence (opt4) from TULV(c109-s)__AF164094.1__N
  source 1..1290: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcaccggcttcgccctggccatcatcctgaaggccctgtacatgctgagcaccagaggcagacagaccatcaaggagaacaagggcaccagaatcagattcaaggacgacagcagctacgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgagaagatcgaggagttcctgatcaagccctgccccttcctgaagaagagcggccccagcaaggaggaggacttcctggtgagcaacgacgcctacctgctgggcagagagaaggccctgagagagagccacctggccgagatcgacgacctgatcgacctggccgccagcggcgaccccaccccccccgacagcatcaagagcccccaggccccctgggtgttcgcctgcgcccccgacagatgcccccccacctgcatctacatcgccggcatggccgagctgggcgccttcttcagcatcctgcaggacatgagaaacaccatcatggccagcaagaccgtgggcaccagcgaggagaagctgaagaagaagagcagcttctaccagagctacctgagaagaacccagagcatgggcatccagctggaccagagaatcatcctgctgttcatgaccgagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5246 - RNA, 1290 nt, synthetic construct
  misc_feature 1..1290: note = derived and/or modified CDS sequence (opt4) from TULV(CHEVRU/Hu/FRA/2015/15.00453)__KT946591.1__N
  source 1..1290: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagacaggccgccgtgagcgccctggaggacaagctggccgacttcaagagaaagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacgtgatgggcttcgccctggccatcatcctgaaggccctgtacatgctgagcaccagaggcagacagaccatcaaggagaacaagggcaccagaatcagattcaaggacgacagcagctacgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgagaagatcgaggagttcctgatcaagccctgccccttcctgaagaagagcggccccagcaaggaggaggacttcctggtgagcaacgacgcctacctgctgggcagagagaaggccctgagagacagccacctggccgagatcgacgacctgatcgacctggccgagagcggcgaccccaccccccccgacagcatcaagagcccccaggccccctgggtgttcgcctgcgcccccgacagatgcccccccacctgcatctacatcgccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgatcgagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5247 - RNA, 1290 nt, synthetic construct
  misc_feature 1..1290: note = derived and/or modified CDS sequence (opt4) from TULV(g20-s)__AF164093.1__N
  source 1..1290: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagacaggccgccgtgagcgccctggaggacaagctggccgacttcaagagaaagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacgtgatgggcttcgccctggccatcatcctgaaggccctgtacatgctgagcaccagaggcagacagaccatcaaggagaacaagggcaccagaatcagattcaaggacgacagcagctacgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgagaagatcgaggagttcctgatcaagccctgccccttcctgaagaagagcggccccagcaaggaggaggacttcctggtgagcaacgacgcctacctgctgggcagagagaaggccctgagagacagccacctggccgagatcgacgacctgatcgacctggccgagagcggcgaccccaccccccccgacagcatcaagagcccccaggccccctgggtgttcgcctgcgcccccgacagatgcccccccacctgcatctacatcgccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgaccgagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5248 - RNA, 1293 nt, synthetic construct
  misc_feature 1..1293: note = derived and/or modified CDS sequence (opt4) from TULV(Sennickerode Sen05/174)__EU439948.1__N
  source 1..1293: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcatcggcttcgccctggccatcgtgctgaaggccctgtacatgctgagcaccagaggcagacagaccatcaaggagaacaagggcaccagaatcagattcaaggacgacagcagcttcgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgacaagatcgaggagttcctgatcaagccctgccccttcctgaagaagcagggcggccccaacaaggacgaggacttcctggtgagcaacgacgcctacttcctgggcagagagaaggccctgagagagagccacctgaacgagatcgacgacctgatcgagctggccgccagcggcgaccccaccccccccgacagcatcaagagcccccaggccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgatggagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5249 - RNA, 1293 nt, synthetic construct
  misc_feature 1..1293: note = derived and/or modified CDS sequence (opt4) from TULV(Sennickerode Sen05/175)__EU439949.1__N
  source 1..1293: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcatcggcttcgccctggccatcgtgctgaaggccctgtacatgctgagcaccagaggcagacagaccatcaaggagaacaagggcaccagaatcagattcaaggacgacagcagcttcgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgacaagatcgaggagttcctgatcaagccctgccccttcctgaagaagcagggcggccccaacaaggacgaggacttcctggtgagcaacgacgcctacttcctgggcagagagaaggccctgagagagagccacctgaacgagatcgacgacctgatcgagctggccgccagcggcgaccccaccccccccgacagcatcaagagcccccaggccccctgggtgttcgcctgcgcccccgacagatgcccccccacctgcatctacgtggccggcatggccgagctgggcgccttcttcagcatcctgcaggacatgagaaagagcatcatggccagcaagaccgtgggcaccgccgaggagaagctgaagaagaagagcagcttctaccagagctacctgagaagaacccagagcatgggcatccagctggaccagagaatcatcctgctgttcatgatggagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5250 - RNA, 1293 nt, synthetic construct
  misc_feature 1..1293: note = derived and/or modified CDS sequence (opt4) from TULV(TUL/Karatal/Ma322/2003)__AM945877.1__N
  source 1..1293: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagaacaccctgcagagcagaagagccgccgtgagcgccctggaggacaagctggccgagttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacgtgatgggcttcgccctggccatcgtgctgaaggccctgtacatgctgagcaccagaggcagacagaccatcaaggagaacaagggcaccagaatcagattcaaggacgacagcagcttcgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgagaagatcgaggagttcctgatcaagccctgccccttcctgaagaagcagggcagcagcggcaaggaggaggagttcctggtgagcaacgacgcctacctgatcggcagagagaagaccctgcaggagagccacctgaccgagatcgacgacctgatcgacctggccgacagcggcgaccccaccccccccgacagcatcaagagcccccaggccccctgggtgttcgcctgcgcccccgacagatgcccccccacctgcatctacatcgccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgatggagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5251 - RNA, 1293 nt, synthetic construct
  misc_feature 1..1293: note = derived and/or modified CDS sequence (opt4) from TULV(Tula/Kosice144/Ma/95)__Y13979.1__N
  source 1..1293: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcatcggcttcgccctggccatcgtgctgaaggccctgtacatgctgagcaccagaggcagacagaccatcaaggagaacaagggcaccagaatcagattcaaggacgacagcagcttcgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgagaagatcgaggagttcctgatcaagccctgccccttcctgaagaagcagggcgcccccggcaaggaggaggacttcctggtgagcaacgacgcctacctgctgggcagagagaaggccctgagagagagccacctggccgagatcgacgacctgatcgacctggccgccagcggcgaccccaccccccccgacagcatcaagagcccccaggccccctgggtgttcgcctgcgcccccgacagatgcccccccacctgcatctacatcgccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgaccgagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5252 - RNA, 1293 nt, synthetic construct
  misc_feature 1..1293: note = derived and/or modified CDS sequence (opt4) from TULV(Tula/Kosice667/Ma/95)__Y13980.1__N
  source 1..1293: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcatcggcttcgccctggccatcgtgctgaaggccctgtacatgctgagcaccagaggcagacagaccatcaaggagaacaagggcaccagaatcagattcaaggacgacagcagcttcgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgagaagatcgaggagttcctgatcaagccctgccccttcctgaagaagcagggcgcccccggcaaggaggaggacttcctggtgagcaacgacgcctacctgctgggcagagagaaggccctgagagagagccacctggccgagatcgacgacctgatcgacctggccgccagcggcgaccccaccccccccgacagcatcaagagcccccaggccccctgggtgttcgcctgcgcccccgacagatgcccccccacctgcatctacatcgccggcatggccgagctgggcgccttcttcagcatcctgcaggacatgagagacaccatcatggccagcaagaccgtgggcaccgccgaggagaagctgaagaagaagagcagcttctaccagagctacctgagaagaacccagagcatgggcatccagctggaccagagaatcatcctgctgttcatgaccgagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5253 - RNA, 1290 nt, synthetic construct
  misc_feature 1..1290: note = derived and/or modified CDS sequence (opt4) from TULV(Tula/Koziky/5247Ma/94)__AJ223600.1__N
  source 1..1290: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcaccggcttcgccctggccatcatcctgaaggccctgtacatgctgagcaccagaggcagacagaccatcaaggagaacaagggcaccagaatcagattcaaggacgacagcagctacgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgagaagatcgaggagttcctgatcaagccctgccccttcctgaagaagaacggccccagcaaggaggaggacttcctggtgagcaacgacgcctacctgctgggcagagagaaggccctgagagagagccacctggccgagatcgacgacctgatcgacctggccgccagcgaggaccccaccccccccgacagcatcaagagcccccaggccccctgggtgttcgcctgcagacccgacagatgcccccccacctgcatctacatcgccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgaccgagtggggcagcgacatcgtgaaccacttccacctgggcgacgacatgagccccgagctgagaaccctggcccagagcctgatcgaccagaaggtgaaggagatcagcaaccaggagcccctgaagatctga

SEQ ID NO: 5254 - RNA, 1290 nt, synthetic construct
  misc_feature 1..1290: note = derived and/or modified CDS sequence (opt4) from TULV(Tula/Moravia/5302v/95)__Z69991.1__N
  source 1..1290: mol_type = other RNA
atgagccagctgaaggagatccaggaggagatcaccagacacgagcagcagatcgtgatcgccagacagaagctgaaggacgtggagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcaccggcttcgccctggccatcatcctgaaggccctgtacatgctgagcaccagaggcagacagaccatcaaggagaacaagggcaccagaatcagattcaaggacgacagcagctacgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgtacagaaacatcatcagccccgtgatgggcgtgatcggcttcagcttcttcgtgaaggactggcccgagaagatcgaggagttcctgatcaagccctgccccttcctgaagaagagcggccccagcaaggaggaggacttcctggtgagcaacgacgcctacctgctgggcagagagaaggccctgagagagagccacctggccgagatcgacgacctgatcgacctggccgccagcggcgaccccaccccccccgacagcatcaagagcccccaggccccctgggtgttcgcctgcagacccgacagatgcccccccacctgcatctacatcgccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgaccgagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5255 - RNA, 1293 nt, synthetic construct
  misc_feature 1..1293: note = derived and/or modified CDS sequence (opt4) from TULV__AF017659.1__N
  source 1..1293: mol_type = other RNA
atgagccagctgaaggagatccaggaggagatcaccagacacgagcagcagatcgtgatcgccagacagaagctgaaggacgccgagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcatcggcttcgccctggccatcgtgctgaaggccctgtacatgctgagcaccagaggcagacagaccatcaaggagaacaagggcaccagaatcagattcaaggacgacagcagcttcgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgagaagatcgaggagttcctgatcaagccctgccccttcctgaagaagcagggcgcccccggcaaggaggaggacttcctggtgagcaacgacgcctacctgctgggcagagagaaggccctgagagagagccacctggccgagatcgacgacctgatcgacctggccgccagcggcgaccccaccccccccgacagcatcaagagcccccaggccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgaccgagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5256 - RNA, 1293 nt, synthetic construct
  misc_feature 1..1293: note = derived and/or modified CDS sequence (opt4) from TULV(Lodz-1)__AF063892.1__N
  source 1..1293: mol_type = other RNA
atgaccgagctgaaggagatccaggaggagatcaccagacacgagcagcagatcgtgatcgccagacagaagctgaaggacgccgagaagaccgtggaggccgaccccgacgacgtgaacaagagcaccctgcagagcagaagagccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcatgggcttcgccctggccatcgtgctgaaggccctgtacatgctgagcaccagaggcagacagaccatcaaggagaacaagggcaccagaatcagattcaaggacgacagcagctacgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgacaagatcgaggagttcctgatcaagccctgccccttcctgaagaagcagggcggccccaacaaggacgaggagttcctggtgagcaacgacgcctacctgctgggcagagagaaggccctgagagagagccacctggccgagatcgacgacctgatcgacctggccgccagcggcgaccccaccccccccgacagcatcaagagcccccaggccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgatggagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5257 - RNA, 1293 nt, synthetic construct
  misc_feature 1..1293: note = derived and/or modified CDS sequence (opt4) from TULV(Lodz-2)__AF063897.1__N
  source 1..1293: mol_type = other RNA
atgaccgagctgaaggagatccaggaggagatcaccagacacgagcagcagatcgtgatcgccagacagaagctgaaggacgccgagaagaccgtggaggccgaccccgacgacgtgaacaagagcaccctgcagagcagatgggccgccgtgagcgccctggaggacaagctggccgacttcaagagacagctggccgacctggtgagcagccagaagatgggcgagaagcccgtggaccccaccggcctggagcccgacgaccacctgaaggagagaagcagcctgagatacggcaacgtgctggacgtgaacgccatcgacatcgacgagcccagcggccagaccgccgactggttcagcatcggccagtacatcatgggcttcgccctggccatcgtgctgaaggccctgtacatgctgagcaccagaggcagacagaccatcaaggagaacaagggcaccagaatcagattcaaggacgacagcagctacgaggagatcaacggcatcagaagacccaagcacctgtacgtgagcatgcccaccgcccagagcaccatgaaggccgacgagctgacccccggcagattcagaaccatcgtgtgcggcctgttccccgcccagatcatgcacagaaacatcatcagccccgtgatgggcgtgatcggcttcagcttcttcgtgaaggactggcccgacaagatcgaggagttcctgatcaagccctgccccttcctgaagaagcagggcggccccaacaaggacgaggagttcctggtgagcaacgacgcctacctgctgggcagagagaaggccctgagagagagccacctggccgagatcgacgacctgatcgacctggccgccagcggcgaccccaccccccccgacagcatcaagagcccccaggccccctgggtgttcgcctgcgcccccgacagatgcccccccacctgcatctacgtggccggcatggccgagctgggcgccttcttcagcatcctgcaggacatgagaaacaccatcatggccagcaagaccgtgggcaccgccgaggagaagctgaagaagaagagcagcttctaccagagctacctgagaagaacccagagcatgggcatccagctggaccagagaatcatcctgctgttcatgatggagtggggcagcgacatcgtgaaccacttccacctgggcgacgacatggaccccgagctgagaaccctggcccagagcctgatcgaccagaaggtgaaggagatcagcaaccaggagcccctgaagatctga

SEQ ID NO: 5258 - RNA, 1449 nt, synthetic construct
  misc_feature 1..1449: note = derived and/or modified CDS sequence (opt4) from CCHFV(IbAr10200)__NC_005302.1/U88410.1__N
  source 1..1449: mol_type = other RNA
atggagaacaagatcgaggtgaacaacaaggacgagatgaacagatggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggacgtgcccaagatcgagcagctgaccggctaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagccacgagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcatcttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagagcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgaggtgcagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5259 - RNA, 1449 nt, synthetic construct
  misc_feature 1..1449: note = derived and/or modified CDS sequence (opt4) from CCHFV(Turkey-Kelkit06)__GQ337053.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaaggacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgcccaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcgagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccaggagaccggcttcaacatccaggacatggacatcgtggccagcgagcacctgctgcaccagagcatcgtgggcaagcagagccccttccagaacgcctacaacgtgaagggcaacgccaccagcgccaacatcatctga

SEQ ID NO: 5260 - RNA, 1449 nt, synthetic construct
  misc_feature 1..1449: note = derived and/or modified CDS sequence (opt4) from CCHFV(Baghdad 12)__AJ538196.1__N
  source 1..1449: mol_type = other RNA
atggagaacaagatcgaggtgaacagcaaggacgagatgaacaagtggttcgaggagttcaagaagggcaacggcctggtggacacctacaccaacagctacagcttctgcgagagcgtgcccaacctggacagattcgtgttccagatggccggcgccaccgacgacgcccagaaggacagcatctacgccagcgccctggtggaggccaccaagttctgcgcccccatctacgagtgcgcctgggccagcagcaccggcatcgtgaagaagggcctggagtggttcgagaagaacaccggcaccatcaagagctgggacgagagctacaccgagctgaaggtggaggtgcccaagatcgagcagctgttcaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatggtgaccaacctgctgaagcacgtggccaaggcccaggagctgtacaagaacagcagcgccctgagagcccagggcgcccagatcgacaccgtgttcagcagctactactggctgtacaaggccggcgtgacccccgagaccttccccaccgtgagccagttcctgttcgagctgggcaagcaccccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccaacaccgagaccaacaacccctgcgccagaaccatcgtgaagctgttcgagatccagaagaccggcttcaacatccagcacatggacatcgtggccagcgagcacctgctgcaccagagcctggtgggcaagcagagccccttccagaacgcctacaacgtgaagggcaacgccaccagcgccaacatcatctga

SEQ ID NO: 5261 - RNA, 1449 nt, synthetic construct
  misc_feature 1..1449: note = derived and/or modified CDS sequence (opt4) from CCHFV(SR3)__AJ538198.1__N
  source 1..1449: mol_type = other RNA
atggagaacaagatcgaggtgaacagcaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggccagcagcaccggcatcgtgaagaagggcctggagtggttcgagaagaacgccggcaccatcaagagctgggacgagagctacaccgagctgaaggtggaggtgcccaagatcgagcagctgagcaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacagcatgatcaccaacctgctgaagcacatcgccaaggcccaggagctgtacaagaacagcagcgccctgagagcccagggcgcccagatcgacaccgtgttcagcagctactactggctgtacaaggccggcgtgacccccgacaccttccccgccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5262 - RNA, 1449 nt, synthetic construct
  misc_feature 1..1449: note = derived and/or modified CDS sequence (opt4) from CCHFV(Gaib)__KX013446.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5263 - RNA, 1449 nt, synthetic construct
  misc_feature 1..1449: note = derived and/or modified CDS sequence (opt4) from CCHFV(Hodzha)__KX013449.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttctgcgtgaacgccaacaccgccgccctgagccagaaggtgctgagcgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgaccaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccaccggcagaatcagcgagatgggcgtgtgcttcggcaccgtgcccgtggccgaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5264 - RNA, 1449 nt, synthetic construct
  misc_feature 1..1449: note = derived and/or modified CDS sequence (opt4) from CCHFV(IbAn7620)__KX013452.1__N
  source 1..1449: mol_type = other RNA
atggagaacaagatcgaggtgaacaacaaggacgagatgaacagatggttcgaggagttcaagaaggagaacggcctggtggacaccttcaccaacagccacagcttctgcgagagcgtgcccaacctggacaagttcgtgttccagatggccagcgccaccgacgacgcccagaaggacagcatctacgccgccgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctgagcaactaccagcaggccgccctgaagtggagaaaggacatcggcttcagagtgaacgccaacaccgccaccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgaggccgagggcaagggcgtgttcgacgaggccaagaagaccgtggaggccctgaacggctacctggacaagcacaaggacgaggtggacaagagcagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccagcaccgaggccaacaacccctgcgccaagaccatcgtgaagctgttcgagatccagaagaagggcttcgtgatcaaggacatggacatcgtggccagcgagcacctgctgcaccagagcctggtgggcaagcagagccccttccagaacgcctacaacgtgaagggcaacgccaccagcgccaacatcatctga

SEQ ID NO: 5265 - RNA, 1449 nt, synthetic construct
  misc_feature 1..1449: note = derived and/or modified CDS sequence (opt4) from CCHFV(K128_76)__KX013455.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccagcctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5266 - RNA, 1449 nt, synthetic construct
  misc_feature 1..1449: note = derived and/or modified CDS sequence (opt4) from CCHFV(K168_125)__KX013461.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgacatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgaccagcgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5267 - RNA, 1449 nt, synthetic construct
  misc_feature 1..1449: note = derived and/or modified CDS sequence (opt4) from CCHFV(K168_40)__KX013458.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgacatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaactacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgaccagcgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5268 - RNA, 1449 nt, synthetic construct
  misc_feature 1..1449: note = derived and/or modified CDS sequence (opt4) from CCHFV(K323_27)__KX013473.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgccttcaacgtgaagggcaacgccaccagcgccaacatcatctga

SEQ ID NO: 5269 - RNA, 1449 nt, synthetic construct
  misc_feature 1..1449: note = derived and/or modified CDS sequence (opt4) from CCHFV(Min)__KX013482.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagctgggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5270 - RNA, 1449 nt, synthetic construct
  misc_feature 1..1449: note = derived and/or modified CDS sequence (opt4) from CCHFV(Saf)__KX013488.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccgaccccgacgacgccgcccagggcagcggccacaccaagagcatcctgaacctgagaaccagcaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5271 - RNA, 1449 nt, synthetic construct
  misc_feature 1..1449: note = derived and/or modified CDS sequence (opt4) from CCHFV(UCCR4459)__KY484031.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccggctaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagctgggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5272 - RNA, 1449 nt, synthetic construct
  misc_feature 1..1449: note = derived and/or modified CDS sequence (opt4) from CCHFV(YL16070)__KY354080.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccgactaccagcaggccgccctgaagtggagaaaggacatcggcttcagagtgaacgccaacaccaccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctgaacaagcacaaggacgaggtggacaaggccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccctgaagtggggcaagagactgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5273 - RNA, 1449 nt, synthetic construct
  misc_feature 1..1449: note = derived and/or modified CDS sequence (opt4) from CCHFV(66019)__AJ010648.1__N
  source 1..1449: mol_type = other RNA
atggagaacaagatcgaggtgaacaacaaggacgagatgaacagatggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccagctaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgaccaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccgaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5274 - RNA, 1449 nt, synthetic construct
  misc_feature 1..1449: note = derived and/or modified CDS sequence (opt4) from CCHFV(8402)__AJ010649.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggagagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgttcaagcacatcgccaaggcccaggagctgtacaagaacctgagcgccctgggcgcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5275 - RNA, 1449 nt, synthetic construct
  misc_feature 1..1449: note = derived and/or modified CDS sequence (opt4) from CCHFV(Bul/HU517)__AY277676.2__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcgccatcaagagctgggacgagaactacgtggagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcagcgacgagaaccccagaggccccgtgagccacgagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5276 - RNA, 1449 nt, synthetic construct
  misc_feature 1..1449: note = derived and/or modified CDS sequence (opt4) from CCHFV(V46/13)__KR011837.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcagcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaaggccgtggaggccctgaacggctacctggacaagcacagagacgaggtggtgaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5277 - RNA, 1449 nt, synthetic construct
  misc_feature 1..1449: note = derived and/or modified CDS sequence (opt4) from CCHFV(1231-CR/TI-2015)__KU161587.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5278 - RNA, 1449 nt, synthetic construct
  misc_feature 1..1449: note = derived and/or modified CDS sequence (opt4) from CCHFV(AP92)__U04958.1__N
  source 1..1449: mol_type = other RNA
atggagaacaagatcgaggtgaacagcaaggacgacctgaacaagtggttcgaggagttcaagaagggcaacggcctggtggacaccttcaccaacagctacagcttctgcgagaacgtgcccaacctggacagattcgtgtaccagatggccagcgccaccgacgacgcccagaaggacagcatctacgccagcgccctggtggaggccaccaagtactgcgcccccatctacgagtgcgcctgggtgagcagcaccggcatcgtgaagaagggcctggagtggttcgagaagaacaccagcaccatcaagagctgggacgagagctacaccgagctgaaggtggacatccccaagatcgagcagctgagcagctaccagcaggccgccctgaagtggagaaaggacatcggcttcagaatcaacgccaacaccaccgccctgagcaacaaggtgctggccgagtacaaggtgcccggcgagatcctggtgcccgtgaaggagatgctgagcgacatgatcagaagaagaaacatcatcctgaacagaggcagcgacgagaaccccagaggccccgtgagccacgagcacatcgagtggtgcagagagttcatcaagggcaagtacatcatggccttcaaccccccctggggcgacatcaacaagagcggcagaagcggcatcgccctggtggccaccggcctggccaagctggccgagaccgagggcaagggcgtgttcgaggaggccaagaagaccgtggaggccctgaaggactacctggacaagcacagagacgaggtggacaagaccagcgccgacaacatggtgaccagcctgctgaagcacatcgccaaggcccaggagctgtacaagaacagcagcgccctgagagcccagggcgcccagatcgacacccccttcagcagcttctactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagcactacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagagcaacaacccctgcgccagaaccatcgtgaagctgttcgagatccagaagaccggcttcgacatcaaggacatggacatcgtggccagcgagcacctgctgcaccagagcctggtgggcaagcagagccccttccagaacgcctacaacgtgaagggcaacgccaccagcgccaacatcatctga

SEQ ID NO: 5279 - RNA, 1449 nt, synthetic construct
  misc_feature 1..1449: note = derived and/or modified CDS sequence (opt4) from CCHFV(C68031)__M86625.1__N
  source 1..1449: mol_type = other RNA
atggagaacaagatcgaggtgaacaacaaggacgagatgaacaagtggttcgaggagttcaagaagggcaacggcctggtggacaccttcaccaacccctacagcttctgcgagagcgtgcccaacctggagagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacatcgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5280 - RNA, 1449 nt, synthetic construct
  misc_feature 1..1449: note = derived and/or modified CDS sequence (opt4) from CCHFV(1-CR/HU-2015)__KU161586.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgtaccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgaccaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5281 - RNA, 1449 nt, synthetic construct
  misc_feature 1..1449: note = derived and/or modified CDS sequence (opt4) from CCHFV(36-ST-2014)__KR814838.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacaccggcaccatcaagagctgggacgacaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacggcaaccccagaggccccgtgagccacgagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagagaaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5282 - RNA, 1449 nt, synthetic construct
  misc_feature 1..1449: note = derived and/or modified CDS sequence (opt4) from CCHFV(37-ST-2009)__KR814835.1__N
  source 1..1449: mol_type = other RNA
atggagaacaagatcgtggtgaacagcaaggacgagatgaacaagtggttcgaggagttcaagaaggtgaacggcctggtggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggacgtgcccaagatcgagcagctggccagctaccagcaggccgccctgaagtggagaaaggacatcggcttcagagtgaacgccaacaccgccgccctgagcagcaaggtgctgagcgagtacaaggtgcccggcgaggtggtgatgcccgtgaaggagatgctgagcgacatgatcagaagaagaaacctgatcctgaacagaggcagcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcatcttcgaggaggccagaaagaccgtggacgccctgaaggactacctggacagacacaaggaggaggtggacaagaccaacgccgacaacatggtgaccaacctgttcaagcacatcgccaaggcccaggagctgtacaagaacagcagcgccctgagagcccagggcgcccagatcgacacccccttcagcagcttctactggctgtacaaggccggcgtgacccccgagaccttccccaccgtgagccagttcctgttcgagctgggcaagcagcccagaggcaccagaaagatgaagaaggccctgctgagcacccccatgaagtggggcaagaagctgtacgagctgttcgccgacgacagcttccagcagaacagaatctacatgcaccccgccgtgctgaccgccggcagagtgagcgagatgggcgtgtgcttcggcaccatccccgtggacaaccccgacgacgccgcccagggcagcggccacaccaagagcatcctgaacctgagaaccagcgccgagaccaacaacccctgcgccagaaccatcgtgaagctgttcgagatccagaaggccggcttcaacatccaggagatggacatcgtggccagcgagcacctgctgcaccagagcctggtgggcaagcagagccccttccagaacgcctacaacgtgaagggcaacgccaccagcgccaacatcatctga

SEQ ID NO: 5283 - RNA, 1449 nt, synthetic construct
  misc_feature 1..1449: note = derived and/or modified CDS sequence (opt4) from CCHFV(59-TK-2012)__KR814833.1__N
  source 1..1449: mol_type = other RNA
atggagaacaagatcgtggtgaacagcaaggacgagatgaacaagtggttcgaggagttcaagaaggtgaacggcctggtggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacaccggcaccatcaagagctgggacgagagctacaccgagctgaaggtggacgtgcccaagatcgagcagctggccagctaccagcaggccgccctgaagtggagaaaggacatcggcttcagagtgaacgccaacaccgccgccctgagcagcaaggtgctgagcgagtacaaggtgcccggcgagatcgtgatgcccgtgaaggagatgctgagcgacatgatcagaagaagaaacctgatcctgaacagaggcagcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcatcttcgaggaggccagaaagaccgtggacgccctgaaggactacctggacagacacaaggaggaggtggacaagaccaacgccgacaacatggtgaccaacctgttcaagcacatcgccaaggcccaggagctgtacaagaacagcagcgccctgagagcccagggcgcccagatcgacacccccttcagcagcttctactggctgtacaaggccggcgtgacccccgagaccttccccaccgtgagccagttcctgttcgagctgggcaagcagcccagaggcaccagaaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggacaaccccgacgacgccgcccagggcagcggccacaccaagagcatcctgaacctgagaaccagcgccgagaccaacaacccctgcgccaagaccatcgtgaagctgttcgagatccagaaggccggcttcaacatccaggagatggacatcgtggccagcgagcacctgctgcaccagagcctggtgggcaagcagagccccttccagaacgcctacaacgtgaagggcaacgccaccagcgccaacatcatctga

SEQ ID NO: 5284 - RNA, 1449 nt, synthetic construct
  misc_feature 1..1449: note = derived and/or modified CDS sequence (opt4) from CCHFV(73-ST-2013)__KR814836.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5285 - RNA, 1449 nt, synthetic construct
  misc_feature 1..1449: note = derived and/or modified CDS sequence (opt4) from CCHFV(75-ST-2010)__KR814845.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcagcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5286 - RNA, 1449 nt, synthetic construct
  misc_feature 1..1449: note = derived and/or modified CDS sequence (opt4) from CCHFV(CHH)__KU707898.1__N
  source 1..1449: mol_type = other RNA
atggagaacaagatcgaggtgaacagcaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggccagcagcaccggcatcgtgaagaagggcctggagtggttcgagaagaacgccggcaccatcaagagctgggacgagagctacaccgagctgaaggtggaggtgcccaagatcgagcagctgagcaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacagcatgatcaccaacctgctgaagcacatcgccaaggcccaggagctgtacaagaacagcagcgccctgagagcccagggcgcccagatcgacaccgtgttcagcagctactactggctgtacaaggccggcgtgacccccgacaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5287 - RNA, 1449 nt, synthetic construct
  misc_feature 1..1449: note = derived and/or modified CDS sequence (opt4) from CCHFV(CJH)__KU707899.1__N
  source 1..1449: mol_type = other RNA
atggagaacaagatcgaggtgaagaacaagcacgagaagaacaagtggttcgaggagttcaagaagggcaacggcctggtggacaccttcaccaacagctacagcttctgcgagaacgtgcccaacctggacagattcgtgttccagatggccggcgccaccgacgacgcccagaaggacagcatctacgccagcgccctggtggaggccaccaagttctgcgcccccatctacgagtgcgcctgggccagcagcaccggcatcgtgaagaagggcctggagtggttcgagaagaacgccggcaccatcaagagctgggacgagagctacaccgagctgaaggtggaggtgcccaagatcgagcagctgagcaactaccagcaggccgccctgaagtggagaaaggacatcggcttcagaggcaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacagcatgatcaccaacctgctgaagcacatcgccaaggcccaggagctgtacaagaacagcagcgccctgagagcccagggcgcccagatcgacaccgtgttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5288 - RNA, 1449 nt, synthetic construct
  misc_feature 1..1449: note = derived and/or modified CDS sequence (opt4) from CCHFV(CLT/TI05146)__DQ227496.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccgactaccagcaggccgccctgaagtggagaaaggacatcggcttcagagtgaacgccaacaccaccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctgaacaagcacaaggacgaggtggacaaggccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccctgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5289 - RNA, 1449 nt, synthetic construct
  misc_feature 1..1449: note = derived and/or modified CDS sequence (opt4) from CCHFV(CYT/TI05099)__DQ227495.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccgactaccagcaggccgccctgaagtggagaaaggacatcggcttcagagtgaacgccaacaccaccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctgaacaagcacaaggacgaggtggacaaggccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccctgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatccccaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5290 - RNA, 1449 nt, synthetic construct
  misc_feature 1..1449: note = derived and/or modified CDS sequence (opt4) from CCHFV(Dubai 616)__JN108025.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccggcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5291 - RNA, 1449 nt, synthetic construct
  misc_feature 1..1449: note = derived and/or modified CDS sequence (opt4) from CCHFV(GRH)__KU707900.1__N
  source 1..1449: mol_type = other RNA
atggagaacaagatcgaggtgaacagcaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggccagcagcaccggcatcgtgaagaagggcctggagtggttcgagaagaacgccggcaccatcaagagctgggacgagagctacaccgagctgaaggtggaggtgcccaagatcgagcagctgagcaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcatgtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacagcatgatcaccaacctgctgaagcacatcgccaaggcccaggagctgtacaagaacagcagcgccctgagagcccagggcgcccagatcgacaccgtgttcagcagctactactggctgtacaaggccggcgtgacccccgacaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5292 - RNA, 1449 nt, synthetic construct
  misc_feature 1..1449: note = derived and/or modified CDS sequence (opt4) from CCHFV(Iran-Gilan69)__KJ027521.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccagctaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5293 - RNA, 1449 nt, synthetic construct
  misc_feature 1..1449: note = derived and/or modified CDS sequence (opt4) from CCHFV(Iran-Isfahan78)__KJ027522.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5294 - RNA, 1449 nt, synthetic construct
  misc_feature 1..1449: note = derived and/or modified CDS sequence (opt4) from CCHFV(Iran-KhRazavi72)__KJ485700.1__N
  source 1..1449: mol_type = other RNA
atggagaacaagatcgaggtgaagaacaagcacgagaagaacaagtggttcgaggagttcaagaagggcaacggcctggtggacaccttccccaacagctacagcttctgcgagaacgtgcccaacctggacagattcgtgttccagatggccggcgccaccgacgacgcccagaaggacagcatctacgccagcgccctggtggaggccaccaagttctgcgcccccatctacgagtgcgcctgggccagcagcaccggcatcgtgaagaagggcctggagtggttcgagaagaacgccggcaccatcaagagctgggacgagagctacaccgagctgaaggtggaggtgcccaagatcgagcagctgagcaactaccagcaggccgccctgaagtggagaaaggacatcggcttcagaggcaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcatcaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacagcatgatcaccaacctgctgaagcacatcgccaaggcccaggagctgtacaagaacagcagcgccctgagagcccagggcgcccagatcgacaccgtgttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5295 - RNA, 1449 nt, synthetic construct
  misc_feature 1..1449: note = derived and/or modified CDS sequence (opt4) from CCHFV(Iran-Zahedan19)__KJ676542.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccggcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctgatcgccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgagatggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5296 - RNA, 1449 nt, synthetic construct
  misc_feature 1..1449: note = derived and/or modified CDS sequence (opt4) from CCHFV(NIV 112143)__JN572089.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctgatcgccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgagatggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5297 - RNA, 1449 nt, synthetic construct
  misc_feature 1..1449: note = derived and/or modified CDS sequence (opt4) from CCHFV(NIVA 118595)__JN572088.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgagatggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5298 - RNA, 1449 nt, synthetic construct
  misc_feature 1..1449: note = derived and/or modified CDS sequence (opt4) from CCHFV(SPU 130/89)__KJ682821.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcgtgtga

SEQ ID NO: 5299 - RNA, 1449 nt, synthetic construct
  misc_feature 1..1449: note = derived and/or modified CDS sequence (opt4) from CCHFV(SPU 18/88)__KJ682818.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatggtgaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5300 - RNA, 1449 nt, synthetic construct
  misc_feature 1..1449: note = derived and/or modified CDS sequence (opt4) from CCHFV(SPU 187/90)__KJ682823.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgcagaccaacaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5301 - RNA, 1449 nt, synthetic construct
  misc_feature 1..1449: note = derived and/or modified CDS sequence (opt4) from CCHFV(SPU 383/87)__KJ682816.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccggcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccagcaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcgtgtga

SEQ ID NO: 5302 - RNA, 1449 nt, synthetic construct
  misc_feature 1..1449: note = derived and/or modified CDS sequence (opt4) from CCHFV(SPU 383/87)__KJ682816.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccggcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccagcaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5303 - RNA, 1449 nt, synthetic construct
  misc_feature 1..1449: note = derived and/or modified CDS sequence (opt4) from CCHFV(SPU 431/85)__KJ682815.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccagcgccaccgacgacgcccagaaggacagcatctacgccagcgccctggtggaggccaccaagttctgcgcccccgtgtacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacaccttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgtgaacatcatctga

SEQ ID NO: 5304 - RNA, 1449 nt, synthetic construct
  misc_feature 1..1449: note = derived and/or modified CDS sequence (opt4) from CCHFV(SPU 45/88)__KJ682819.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5305 - RNA, 1449 nt, synthetic construct
  misc_feature 1..1449: note = derived and/or modified CDS sequence (opt4) from CCHFV(SPU 48/90)__KJ682822.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatgatcaccaacctgttcaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccagaaccatcgtgaagctgttcgagatccagaagaccggcttcagcatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5306 - RNA, 1449 nt, synthetic construct
  misc_feature 1..1449: note = derived and/or modified CDS sequence (opt4) from CCHFV(SPU 497/88)__KJ682820.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcgccatccccgtggccaaccccgacgacgccgcccagggcagcggccacaccaagagcatcctgaacctgagaaccaacaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5307 - RNA, 1449 nt, synthetic construct
  misc_feature 1..1449: note = derived and/or modified CDS sequence (opt4) from CCHFV(SPU 556/87)__KJ682817.1__N
  source 1..1449: mol_type = other RNA
atggagaacaagatcgaggtgaacaacaaggacgagatgaacagatggttcgaggagttcaagaagggcaacggcctggtggacaccttcaccaacagctacagcttctgcgagagcgtgcccaacctggacagattcgtgttccagatggccggcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5308 - RNA, 1449 nt, synthetic construct
  misc_feature 1..1449: note = derived and/or modified CDS sequence (opt4) from CCHFV(SPU 92/01)__KC880335.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgcagaccaacaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgtgaacatcatctga

SEQ ID NO: 5309 - RNA, 1449 nt, synthetic construct
  misc_feature 1..1449: note = derived and/or modified CDS sequence (opt4) from CCHFV(SRR)__KU707901.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccggcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgagatggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5310 - RNA, 1449 nt, synthetic construct
  misc_feature 1..1449: note = derived and/or modified CDS sequence (opt4) from CCHFV(STV/HU29223)__AF481802.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaacctgagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5311 - RNA, 1449 nt, synthetic construct
  misc_feature 1..1449: note = derived and/or modified CDS sequence (opt4) from CCHFV(TAJ/HU8966)__AY049083.2__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccgaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5312 - RNA, 1449 nt, synthetic construct
  misc_feature 1..1449: note = derived and/or modified CDS sequence (opt4) from CCHFV(TAJ/HU8975)__AY297692.2__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacatcgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5313 - RNA, 1449 nt, synthetic construct
  misc_feature 1..1449: note = derived and/or modified CDS sequence (opt4) from CCHFV(TAJ/HU8978)__AY297691.2__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccggcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgttcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagagaaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccagcttcagcagctactactggctgtacaaggccggcagaacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5314 - RNA, 1449 nt, synthetic construct
  misc_feature 1..1449: note = derived and/or modified CDS sequence (opt4) from CCHFV(Uzbek/TI10145)__AF481799.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccgactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5315 - RNA, 1449 nt, synthetic construct
  misc_feature 1..1449: note = derived and/or modified CDS sequence (opt4) from CCHFV(ROS/TI28044)__AY277672.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagcccggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcgccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5316 - RNA, 1449 nt, synthetic construct
  misc_feature 1..1449: note = derived and/or modified CDS sequence (opt4) from CCHFV(7001)__AF415236.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggaggtgcccaagatcgagcagctggccgactaccagcaggccgccctgaagtggagaaaggacatcggcttcagagtgaacgccaacaccaccgccctgagccacaaggtgctggccgagtacaaggtgcccggcgagatcgtgatgagcgtgaaggagatgctgagcgacatgatcagaagaagaaacctgatcctgaacagaggcggcgacgagagccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctgaacaagcacaaggacgaggtggacaaggccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccctgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgccccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5317 - RNA, 1449 nt, synthetic construct
  misc_feature 1..1449: note = derived and/or modified CDS sequence (opt4) from CCHFV(79121M18)__GU477494.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggaggtgcccaagatcgagcagctggccgactaccagcaggccgccctgaagtggagaaaggacatcggcttcagagtgaacgccaacaccaccgccctgagccacaaggtgctggccgagtacaaggtgcccggcgagatcgtgatgagcgtgaaggagatgctgagcgacatgatcagaagaagaaacctgatcctgaacagaggcggcgacgagagccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctgaacaagcacaaggacgaggtggacaaggccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccctgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5318 - RNA, 1449 nt, synthetic construct
  misc_feature 1..1449: note = derived and/or modified CDS sequence (opt4) from CCHFV(AP92)__DQ211638.1__N
  source 1..1449: mol_type = other RNA
atggagaacaagatcgaggtgaacagcaaggacgacctgaacaagtggttcgaggagttcaagaagggcaacggcctggtggacaccttcaccaacagctacagcttctgcgagaacgtgcccaacctggacagattcgtgtaccagatggccagcgccaccgacgacgcccagaaggacagcatctacgccagcgccctggtggaggccaccaagtactgcgcccccatctacgagtgcgcctgggtgagcagcaccggcatcgtgaagaagggcctggagtggttcgagaagaacaccagcaccatcaagagctgggacgagagctacaccgagctgaaggtggacatccccaagatcgagcagctgagcagctaccagcaggccgccctgaagtggagaaaggacatcggcttcagaatcaacgccaacaccaccgccctgagcaacaaggtgctggccgagtacaaggtgcccggcgagatcctggtgcccgtgaaggagatgctgagcgacatgatcagaagaagaaacatcatcctgaacagaggcagcgacgagaaccccagaggccccgtgagccacgagcacatcgagtggtgcagagagttcatcaagggcaagtacatcatggccttcaaccccccctggggcgacatcaacaagagcggcagaagcggcatcgccctggtggccaccggcctggccaagctggccgagaccgagggcaagggcgtgttcgaggaggccaagaagaccgtggaggccctgaaggactacctggacaagcacagagacgaggtggacaagaccagcgccgacaacatggtgaccagcctgctgaagcacatcgccaaggcccaggagctgtacaagaacagcagcgccctgagagcccagggcgcccagatcgacacccccttcagcagcttctactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagagcaacaacccctgcgccagaaccatcgtgaagctgttcgagatccagaagaccggcttcgacatcaaggacatggacatcgtggccagcgagcacctgctgcaccagagcctggtgggcaagcagagccccttccagaacgcctacaacgtgaagggcaacgccaccagcgccaacatcatctga

SEQ ID NO: 5319 - RNA, 1449 nt, synthetic construct
  misc_feature 1..1449: note = derived and/or modified CDS sequence (opt4) from CCHFV(ArD15786)__DQ211640.1__N
  source 1..1449: mol_type = other RNA
atggagaacaagatcgaggtgaacaacaaggacgagctgaacaagtggttcgaggagttcaagaagggcaacggcctggtggacaccttcaccaacagctacagcttctgcgagaacgtgcccaacctggacagattcgtgttccagatggccggcgccaccgacgacgcccagaaggacagcatctacgccagcgccctggtggaggccaccaagtactgcgcccccatctacgagtgcgcctgggtgagcagcaccggcatcgtgaagagaggcctggagtggttcgagaagaacaccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctgagcgagtacaaggtgcccggcgagatcgtgatgagcgtgaaggagatgctgagcgacatgatcagaagaagaaacctgatcctgaacagaggcggcgacgagaaccccagaggccccgtgagcaaggagcacatcgagtggtgcagagagttcgtgaagggcaagtacatcatggccttcaaccccccctggggcgacgtgaacaagagcggcagaagcggcatcgccctggtggccaccggcctggccaagctggccgagaccgagggcaagggcgtgttcgaggaggccaagaagaccgtggaggccctgaaggagtacctggacaagcacaaggacgaggtggacaaggccagcgccgacagcatggtgaccaacctgctgaagcacatcaccaaggcccaggagctgtacaagaacagcagcgccctgagagcccagggcgcccagatcgacacccccttcagcagcttctactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacagcgagaccaacaacccctgcgccaagaccatcgtgaagctgttcgaggtgcagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5320 - RNA, 1449 nt, synthetic construct
  misc_feature 1..1449: note = derived and/or modified CDS sequence (opt4) from CCHFV(ArD39554)__DQ211641.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgaccacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5321 - RNA, 1449 nt, synthetic construct
  misc_feature 1..1449: note = derived and/or modified CDS sequence (opt4) from CCHFV(BT958)__EF123122.1__N
  source 1..1449: mol_type = other RNA
atggagaacaagatcgaggtgaacaacaaggacgagatgaacagatggttcgaggagttcaagaaggagaacggcctggtggacaccttcaccaacagccacagcttctgcgagagcgtgcccaacctggacaagttcgtgttccagatggccagcgccaccgacgacgcccagaaggacagcatctacgccgccgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctgagcaactaccagcaggccgccctgaagtggagaaaggacatcggcttcagagtgaacgccaacaccgccaccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgaggccgagggcaagggcgtgttcgacgaggccaagaagaccgtggaggccctgaacggctacctggacaagcacaaggacgaggtggacaagagcagcgccgacagcatgatcaccaacctgctgaagcacatcgccaaggcccaggagctgtacagaaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccagcaccgaggccaacaacccctgcgccaagaccatcgtgaagctgttcgagatccagaagaagggcttcgtgatcaaggacatggacatcgtggccagcgagcacctgctgcaccagagcctggtgggcaagcagagccccttccagaacgcctacaacgtgaagggcaacgccaccagcgccaacatcatctga

SEQ ID NO: 5322 - RNA, 1449 nt, synthetic construct
  misc_feature 1..1449: note = derived and/or modified CDS sequence (opt4) from CCHFV(C-68031)__DQ211642.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggagagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacatcgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5323 - RNA, 1449 nt, synthetic construct
  misc_feature 1..1449: note = derived and/or modified CDS sequence (opt4) from CCHFV(China)__AF354296.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggagagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagcggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccggcggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgccacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgagactgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5324 - RNA, 1449 nt, synthetic construct
  misc_feature 1..1449: note = derived and/or modified CDS sequence (opt4) from CCHFV(China)__AF358784.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggaggtgcccaagatcgagcagttcgccgactaccagcaggccgccctgaagtggagaaaggacatcggcttcagagtgaacgccaacaccaccgccctgagccacaaggtgctggccgagtacaaggtgcccggcgagatcgtgatgagcgtgaaggagatgctgagcgacatgatcagaagaagaaacctgatcctgaacagaggcggcgacgagagccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctgaacaagcacaaggacgaggtggacaaggccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccctgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5325 - RNA, 1449 nt, synthetic construct
  misc_feature 1..1449: note = derived and/or modified CDS sequence (opt4) from CCHFV(China)__AF362080.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggagagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctgaccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcacctacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5326 - RNA, 1449 nt, synthetic construct
  misc_feature 1..1449: note = derived and/or modified CDS sequence (opt4) from CCHFV(China)__AY029157.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggagagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5327 - RNA, 1449 nt, synthetic construct
  misc_feature 1..1449: note = derived and/or modified CDS sequence (opt4) from CCHFV(DAK 8194)__U88411.1__N
  source 1..1449: mol_type = other RNA
atggagaacaagatcgaggtgaacaacaaggacgagctgaacaagtggttcgaggagttcaagaagggcaacggcctggtggacaccttcaccaacagctacagcttctgcgagaacatgcccaacctggacagattcgtgttccagatggccggcgccaccgacgacgcccagaaggacagcatctacgccagcgccctggtggaggccaccaagtactgcgcccccatctacgagtgcgcctgggtgagcagcaccggcatcgtgaagagaggcctggagtggttcgagaagaacaccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctgagcgagtacaaggtgcccggcgagatcgtgatgagcgtgaaggagatgctgagcgacatgatcagaagaagaaacctgatcctgaacagaggcggcgacgagaaccccagaggccccgtgagcaaggagcacatcgagtggtgcagagagttcgtgaagggcaagtacatcatggccttcaaccccccctggggcgacgtgaacaagagcggcagaagcggcatcgccctggtggccaccggcctggccaagctggccgagaccgagggcaagggcgtgttcgaggaggccaagaagaccgtggaggccctgaaggagtacctggacaagcacaaggacgaggtggacaaggccagcgccgacagcatggtgaccaacctgctgaagcacatcaccaaggcccaggagctgtacaagaacagcagcgccctgagagcccagggcgcccagatcgacacccccttcagcagcttctactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccgaccccgacgacgccgcccagggcagcggccacaccaagagcatcctgaacctgagaaccagcagcgagaccaacaacccctgcgccaagaccatcgtgaagctgttcgaggtgcagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5328 - RNA, 1449 nt, synthetic construct
  misc_feature 1..1449: note = derived and/or modified CDS sequence (opt4) from CCHFV(Drosdov)__U88412.1__N
  source 1..1449: mol_type = other RNA
atggagaacaagatcgaggtgaacagcaaggacgagatgaacaagtggttcgaggagttcaagaaggagaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5329 - RNA, 1449 nt, synthetic construct
  misc_feature 1..1449: note = derived and/or modified CDS sequence (opt4) from CCHFV(Eskisehir23-2012)__KR092376.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacaccggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcggcgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagagaaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5330 - RNA, 1449 nt, synthetic construct
  misc_feature 1..1449: note = derived and/or modified CDS sequence (opt4) from CCHFV(Hodzha)__AY223475.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctgagcgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgaccaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccgtgcccgtggccgaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5331 - RNA, 1449 nt, synthetic construct
  misc_feature 1..1449: note = derived and/or modified CDS sequence (opt4) from CCHFV(Iran-52)__DQ446212.1__N
  source 1..1449: mol_type = other RNA
atggagaacaagatcgaggtgaacagcaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggccagcagcaccggcatcgtgaagaagggcctggagtggttcgagaagaacgccggcaccatcaagagctgggacgagagctacaccgagctgaaggtggaggtgcccaagatcgagcagctgagcaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacagcatgatcaccaacctgctgaagcacatcgccaaggcccaggagctgtacaagaacagcagcgccctgagagcccagggcgcccagatcgacaccgtgttcagcagctactactggctgtacaaggccggcgtgacccccgacaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccaacaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5332 - RNA, 1449 nt, synthetic construct
  misc_feature 1..1449: note = derived and/or modified CDS sequence (opt4) from CCHFV(Iran-53)__DQ446213.1__N
  source 1..1449: mol_type = other RNA
atggagaacaagatcgaggtgaacagcaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggccagcagcaccggcatcgtgaagaagggcctggagtggttcgagaagaacgccggcaccatcaagagctgggacgagagctacaccgagctgaaggtggaggtgcccaagatcgagcagctgagcaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacaagggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacagcatgatcaccaacctgctgaagcacatcgccaaggcccaggagctgtacaagaacagcagcgccctgagagcccagggcgcccagatcgacaccgtgttcagcagctactactggctgtacaaggccggcgtgacccccgacaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccaacaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5333 - RNA, 1449 nt, synthetic construct
  misc_feature 1..1449: note = derived and/or modified CDS sequence (opt4) from CCHFV(JD 206)__U88414.1__N
  source 1..1449: mol_type = other RNA
atggagaacaagatcgaggtgaacagcaaggacgagatgaacaagtggttcgaggagttcaagaagggcaacggcctggtggacaccttcaccaacagctacagcttctgcgagaacgtgcccaacctggacagattcgtgttccagatggccagcgccaccgacgacgcccagaaggacagcatctacgccagcgccctggtggaggccaccaagttctgcgcccccatctacgagtgcgcctgggccagcagcaccggcatcgtgaagaagggcctggagtggttcgagaagaacgccggcaccatcaagagctgggacgagagctacaccgagctgaaggtggaggtgcccaagatcgagcagctgagcaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcatgtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacagcatgatcaccaacctgctgaagcacatcgccaaggcccaggagctgtacaagaacagcagcgccctgagagcccagggcgcccagatcgacaccgtgttcagcagctactactggctgtacaaggccggcgtgacccccgacaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5334 - RNA, 1449 nt, synthetic construct
  misc_feature 1..1449: note = derived and/or modified CDS sequence (opt4) from CCHFV(Kashmanov)__DQ211644.1__N
  source 1..1449: mol_type = other RNA
atggagaacaagatcgaggtgaacagcaaggacgagatgaacaagtggttcgaggagttcaagaaggagaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5335 - RNA, 1449 nt, synthetic construct
  misc_feature 1..1449: note = derived and/or modified CDS sequence (opt4) from CCHFV(NIV 10405051)__JF922681.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgagatggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatcgacatcgtggccagcgagcacctgctgcaccagagcctggtgggcaagcagagccccttccagaacgcctacaacgtgaagggcaacgccaccagcgccaacatcatctga

SEQ ID NO: 5336 - RNA, 1449 nt, synthetic construct
  misc_feature 1..1449: note = derived and/or modified CDS sequence (opt4) from CCHFV(Oman)__DQ211645.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggccagcagcaccggcatcgtgaagaagggcctggagtggttcgagaagaacgccggcaccatcaagagctgggacgagagctacaccgagctgaaggtggaggtgcccaagatcgagcagctgagcaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcatcaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacagcatgatcaccaacctgctgaagcacatcgccaaggcccaggagctgtacaagaacagcagcgccctgagagcccagggcgcccagatcgacaccgtgttcagcagctactactggctgtacaaggccggcgtgacccccgacaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5337 - RNA, 1449 nt, synthetic construct
  misc_feature 1..1449: note = derived and/or modified CDS sequence (opt4) from CCHFV(SCT ex Afghanistan)__JX908640.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggccagcagcaccggcatcgtgaagaagggcctggagtggttcgagaagaacgccggcaccatcaagagctgggacgagagctacaccgagctgaaggtggaggtgcccaagatcgagcagctgagcaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcatcaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacagcatgatcaccaacctgctgaagcacatcgccaaggcccaggagctgtacaagaacagcagcgccctgagagcccagggcgcccagatcgacaccgtgttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgccctgggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5338 - RNA, 1449 nt, synthetic construct
  misc_feature 1..1449: note = derived and/or modified CDS sequence (opt4) from CCHFV(Semunya)__DQ076413.1__N
  source 1..1449: mol_type = other RNA
atggagaacaagatcgaggtgaccagcaaggacgagatgaacagatggttcgaggagttcaagaagagcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtgggcgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacggcatggtgaccaacctgctgaagcacatcgccaaggcccaggagctgtacaagaacagcagcgccctgagagcccagggcgcccagatcgacacccccttcagcagcttctactggctgtacaaggccggcgtgagccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccaggagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5339 - RNA, 1449 nt, synthetic construct
  misc_feature 1..1449: note = derived and/or modified CDS sequence (opt4) from CCHFV(SK 2015/human)__KX129738.1__N
  source 1..1449: mol_type = other RNA
atggagaacaagatcgaggtgaacaacaaggacgagatgaacaagtggttcgaggagttcaagaagggcaacggcctggtggacacctacaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggccagcagcaccggcatcgtgaagaagggcctggagtggttcgagaagaacgccggcaccatcaagctgtgggacgagagctacgccgagctgaaggtggaggtgcccaagatcgagcagctgagcaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacagcatgatcaccaacctgctgaagcacatcgccaaggcccaggagctgtacaagaacagcagcgccctgagagcccagggcgcccagatcgacaccgtgttcagcagctactactggctgtacaaggccggcgtgacccccgacaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccgtgcccgtggccaaccccgacgacgccgccctgggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5340 - RNA, 1449 nt, synthetic construct
  misc_feature 1..1449: note = derived and/or modified CDS sequence (opt4) from CCHFV(SPU128/81/7)__DQ076415.1__N
  source 1..1449: mol_type = other RNA
atggagaacaagatcgaggtgaacaacaagcacgagatgaacaagtggttcgaggagttcaagaagggcaacggcctggtggacaccttcaccaacagctacagcttctgcgagagcgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggtgctgaacggctacctggacaagcacaaggacgaggtggacagagccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccagaaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5341 - RNA, 1449 nt, synthetic construct
  misc_feature 1..1449: note = derived and/or modified CDS sequence (opt4) from CCHFV(Sudan Al-Fulah 4-2008)__GQ862372.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagagaggcctggagtggttcgagaagaacgccggcaccatcaagagctgggacgagagctacaccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaaccagatcctgaacagaggcggcgacgagaaccccagaggccccgtgagcagagagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccagaaccatcgtgaagctgttcgagatccagaagaccggcttcagcatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5342 - RNA, 1449 nt, synthetic construct
  misc_feature 1..1449: note = derived and/or modified CDS sequence (opt4) from CCHFV(TAJUK)__JN086996.1__N
  source 1..1449: mol_type = other RNA
atggagaacaagatcgaggtgaacaacaaggacgagatgaacaagtggttcgaggagttcaagaagggcaacggcctggtggacaccttcaccaacagctacagcttctgcgagagcgtgcccaacctggacagattcgtgttccagatggccagcgccaccgacgaggcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggaggtgcccaagatcgagcagctggccaactaccagcaggccgccctgaagtggagaaaggacatcggcttcagagtgaacgccaacaccgccgccctgagccacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacaaggacgaggtggacaaggccagcgccgacaacatgatcaccaacctgctgaagcacatcgccaaggcccaggagctgtacaagaacagcagcgccctgagagcccagggcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5343 - RNA, 1449 nt, synthetic construct
  misc_feature 1..1449: note = derived and/or modified CDS sequence (opt4) from CCHFV(UG3010)__DQ211650.1__N
  source 1..1449: mol_type = other RNA
atggagaacaagatcgaggtgaccagcaaggacgagatgaacagatggttcgaggagttcaagaagagcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtgggcgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggacctgaacggctacctggacaagcacaaggacgaggtggacaaggccagcgccgacggcatggtgaccaacctgctgaagcacatcgccaaggcccaggagctgtacaagaacagcagcgccctgagagcccagggcgcccagatcgacacccccttcagcagcttctactggctgtacaaggccggcgtgagccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccaggagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5344 - RNA, 1449 nt, synthetic construct
  misc_feature 1..1449: note = derived and/or modified CDS sequence (opt4) from CCHFV(UGANDA 3010)__U88416.1__N
  source 1..1449: mol_type = other RNA
atggagaacaagatcgaggtgaccagcaaggacgagatgaacagatggttcgaggagttcaagaagagcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtgggcgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggacctgaacggctacctggacaagcacaaggacgaggtggacaaggccagcgccgacggcatggtgaccaacctgctgaagcacatcgccaaggcccaggagctgtacaagaacagcagcgccctgctgctgcagggcgcccagatcgacacccccttcagcagcttctactggctgtacaaggccggcgtgagccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccaggagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgggcaccaacaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5345 - RNA, 1449 nt, synthetic construct
  misc_feature 1..1449: note = derived and/or modified CDS sequence (opt4) from CCHFV(UK ex Bulgaria)__KM201260.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccagattctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5346 - RNA, 1449 nt, synthetic construct
  misc_feature 1..1449: note = derived and/or modified CDS sequence (opt4) from CCHFV(Yozgat19-2012)__KR092375.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaagcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccagaagaccggcttcaacatccaggacatggacatcgtggccagcgagcacctgctgcaccagagcctggtgggcaagcagagccccttccagaacgcctaccacgtgaagggcaacgccaccagcgccaacatcatctga

SEQ ID NO: 5347 - RNA, 1449 nt, synthetic construct
  misc_feature 1..1449: note = derived and/or modified CDS sequence (opt4) from CCHFV(Yozgat207-2011)__KR092377.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgctgaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccaggagaccggcttcaacatccaggacatggacatcgtggccagcgagcacctgctgcaccagagcctggtgggcaagcagagccccttccagaacgcctacaacgtgaagggcaacgccaccagcgccaacatcatctga

SEQ ID NO: 5348 - RNA, 1452 nt, synthetic construct
  misc_feature 1..1452: note = derived and/or modified CDS sequence (opt4) from DUGV(ArD44313)__AF434161.1__N
  source 1..1452: mol_type = other RNA
atggagaaccagatcaaggccaacaacaagaaggagttcgacgagtggttcaagcccttcagcgagaagctgcagctgagaagcaacctgaccaacagcgccagcctgtgcgacagagtgcccgacctggccctggccgagatgaagatggccctggccaccgacgacaaggagaaggacagcatcttcagcaacgccctggtggaggccaccagattctgcgcccccatctacgagtgcgcctggacctgcagcaccggcgtggtgcagaagagcctgagctggttcgacaagaacaaggacttcatcaagctgtgggacgccaagtacatggacctgaagaagggcatccccgagcccgagcagctggtgagctaccagcaggccgcccagaagtggagaaaggacgtgggctacgagatcaaccagttcaccagaagcctgacccaccccgtggtggccgagtacaaggtgcccggcgagatcgccgtggacgtgaaggagatgctgagcgacatgatcagaagaagaaacgtgctgctgaacggcgacggcgagaacgccggcaagaagggccccatcagcagagagcacgtgagctggggcagagagctggccggcggcaagttccaggtggtgttcaaccccccctggggcgacatcaacaagtgcggcaagagcggcatccccctggccgccaccgccatggtgaaggtggccgagctggacggcagcaagaagctggaggacatcagacaggccctgctggacctgaagaagtgggtggaggacaacaaggacgccctggaggacggcaagggcaacgagctggtgcagaccatgaccaagcacctggcccaggccgtggagctgagcaagaagagcaacgccctgagagcccagggcgcccagatcgacacccccttcagcgcctactactgggcctggagcgccggcgtgaagcccgagaccttcttcaccctgagccagttcctgttcgagatgggccagagcgccagaggcggcaagaagatgatcaaggccctgaccagcacccccctgagatggggcaagggcctgatcaacctgttcgccgacgacgacttcctgggcaacagactgtacatgcaccccgccgtgctgacccccggcagaatgagcgagatgggcgcctgcttcggcgtgatccccgtggccagccccgaggacgccatcctgggcagcggccacagcaagaacatcctgaacttcaagatcgacaccagcgtgcagaacccctgcgccagcaccatcgtgcagctgtacagaatccagaagagcggcttcgacctggagagcctggaggtggtgagcaccgagcacctgctgcaccagagcttcgtgggcaagagatgccccacccagaacgcctacaaggtgagaggcaacgccaccaacgtgaacatcatctga

SEQ ID NO: 5349 - RNA, 1452 nt, synthetic construct
  misc_feature 1..1452: note = derived and/or modified CDS sequence (opt4) from DUGV(ArD16095)__AF434162.1__N
  source 1..1452: mol_type = other RNA
atggagaaccagatcaaggccaacaacaagaaggagttcgacgagtggttcaagcccttcagcgagaagctgcagctgagaagcaacctgaccaacagcgccagcctgtgcgacagagtgcccgacctggccctggccgagatgaagatggccctggccaccgacgacaaggagaaggacagcatcttcagcaacgccctggtggaggccaccagattctgcgcccccatctacgagtgcgcctggacctgcagcaccggcgtggtgcagaagagcctgagctggttcgacaagaacaaggacttcatcaagctgtgggacagcaagtacatggacctgagaaagggcatccccgagcccgagcagctggtgagctaccagcaggccgcccagaagtggagaaaggacgtgggctacgagatcaaccagttcaccagaagcctgacccaccccgtggtggccgagtacaaggtgcccggcgagatcgccgtggacgtgaaggagatgctgagcgacatgatcagaagaagaaacgtgctgctgaacggcgacggcgagaacgccggcaagaagggccccatcagcagagagcacgtgagctggggcagagagctggccggcggcaagttccaggtggtgttcaaccccccctggggcgacatcaacaagtgcggcaagagcggcatccccctggccgccaccgccatggtgaaggtggccgagctggacggcagcaagaagctggaggacatcagacaggccctgctggacctgaagaagtgggtggaggacaacaaggacgccctggaggacggcaagggcaacgagctggtgcagaccatgaccaagcacctggcccaggccgtggagctgagcaagaagagcaacgccctgagagcccagggcgcccagatcgacacccccttcagcgcctactactgggcctggagcgccggcgtgaagcccgagaccttcttcaccctgagccagttcctgttcgagatgggccagagcgccagaggcggcaagaagatgatcaaggccctgaccagcacccccctgagatggggcaagggcctgatcaacctgttcgccgacgacgacttcagcggcaacagactgtacatgcaccccgccgtgctgacccccggcagaatgagcgagatgggcgcctgcttcggcgtgatccccgtggccagccccgaggacgccatcctgggcagcggccacagcaagaacatcctgaacttcaagatcgacaccagcgtgcagaacccctgcgccagcaccatcgtgcagctgtacagaatccagaagagcggcttcgacctggagagcctggaggtggtgagcaccgagcacctgctgcaccagagcttcgtgggcaagagatgccccacccagaacgcctacaaggtgagaggcaacgccaccaacgtgaacatcatctga

SEQ ID NO: 5350 - RNA, 1452 nt, synthetic construct
  misc_feature 1..1452: note = derived and/or modified CDS sequence (opt4) from DUGV(IbH11480)__AF434163.1__N
  source 1..1452: mol_type = other RNA
atggagaaccagatcaaggccaacaacaagaaggagttcgacgagtggttcaagcccttcagcgagaagctgcagctgagaagcaacctgaccaacagcgccagcctgtgcgacagagtgcccgacctggccctggccgagatgaagatggccctggccaccgacgacaaggagaaggacagcatcttcagcaacgccctggtggaggccaccagattctgcgcccccatctacgagtgcgcctggacctgcagcaccggcgtggtgcagaagagcctgagctggttcgacaagaacaaggacttcatcaagctgtgggacgccaagtacatggacctgagaaagggcatccccgagcccgagcagctggtgagctaccagcaggccgcccagaagtggagaaaggacgtgggctacgagatcaaccagttcaccagaagcctgacccaccccgtggtggccgagtacaaggtgcccggcgagatcgccgtggacgtgaaggagatgctgagcgacatgatcagaagaagaaacgtgctgctgaacggcgacggcgagaacgccggcaagaagggccccatcagcagagagcacgtgagctggggcagagagctggccggcggcaagttccaggtggtgttcaaccccccctggggcgacatcaacaagtgcggcaagagcggcatccccctggccgccaccgccatggtgaaggtggccgagctggacggcagcaagaagctggaggacatcagacaggccctgctggacctgaagaagtgggtggaggacaacaaggacgccctggaggacggcaagggcaacgagctggtgcagaccatgaccaagcacctggcccaggccgtggagctgagcaagaagagcaacgccctgagagcccagggcgcccagatcgacacccccttcagcgccttctactgggcctggagcgccggcgtgaagcccgagaccttcttcaccctgagccagttcctgttcgagatgggccagagcgccagaggcggcaagaagatgatcaaggccctgaccagcacccccctgagatggggcaagggcctgatcaacctgttcgccgacgacgacttcctgggcaacagactgtacatgcaccccgccgtgctgacccccggcagaatgagcgagatgggcgcctgcttcggcgtgatccccgtggccagccccgaggacgccatcctgggcagcggccacagcaagaacatcctgaacttcaagatcgacaccagcgtgcagaacccctgcgccagcaccatcgtgcagctgtacagaatccagaagagcggcttcgacctggagagcctggaggtggtgagcaccgagcacctgctgcaccagagcttcgtgggcaagagatgccccacccagaacgcctacaaggtgagaggcaacgccaccaacgtgaacatcatctga

SEQ ID NO: 5351 - RNA, 1452 nt, synthetic construct
  misc_feature 1..1452: note = derived and/or modified CDS sequence (opt4) from DUGV(IbAr1792)__AF434164.1__N
  source 1..1452: mol_type = other RNA
atggagaaccagatcaaggccaacaacaagaaggagttcgacgagtggttcaagcccttcagcgagaagctgcagctgagaagcaacctgaccaacagcgccagcctgtgcgacagagtgcccgacctggccctggccgagatgaagatggccctggccaccgacgacaaggagaaggacagcatcttcagcaacgccctggtggaggccaccagattctgcgcccccatctacgagtgcgcctggacctgcagcaccggcgtggtgcagaagagcctgagctggttcgacaagaacaaggacttcatcaagctgtgggacgccaagtacatggacctgagaaagggcatccccgagcccgagcagctggtgagctaccagcaggccgcccagaagtggagaaaggacgtgggctacgagatcaaccagttcaccagaagcctgacccaccccgtggtggccgagtacaaggtgcccggcgagatcgccgtggacgtgaaggagatgctgagcgacatgatcagaagaagaaacgtgctgctgaacggcgacggcgagaacgccggcaagaagggccccatcagcagagagcacgtgagctggggcagagagctggccggcggcaagttccaggtggtgttcaaccccccctggggcgacatcaacaagtgcggcaagagcggcatccccctggccgccaccgccatggtgaaggtggccgagctggacggcagcaagaagctggaggacatcagacaggccctgctggacctgaagaagtgggtggaggacaacaaggacgccctggaggacggcaagggcaacgagctggtgcagaccatgaccaagcacctggcccaggccgtggagctgagcaagaagagcaacgccctgagagcccagggcgcccagatcgacacccccttcagcgcctactactgggcctggagcgccggcgtgaagcccgagaccttcttcaccctgagccagttcctgttcgagatgggccagagcgccagaggcggcaagaagatgatcaaggccctgaccagcacccccctgagatggggcaagggcctgatcaacctgttcgccgacgacgacttcctgggcaacagactgtacatgcaccccgccgtgctgacccccggcagaatgagcgagatgggcgcctgcttcggcgtgatccccgtggccagccccgaggacgccatcctgggcagcggccacagcaagaacatcctgaacttcaagatcgacaccagcgtgcagaacccctgcgccagcaccatcgtgcagctgtacagaatccagaagagcggcttcgacctggagagcctggaggtggtgagcaccgagcacctgctgcaccagagcttcgtgggcaagagatgccccacccagaacgcctacaaggtgagaggcaacgccaccaacgtgaacatcatctga

SEQ ID NO: 5352 - RNA, 1452 nt, synthetic construct
  misc_feature 1..1452: note = derived and/or modified CDS sequence (opt4) from DUGV(KT281/75)__AF434165.1__N
  source 1..1452: mol_type = other RNA
atggagaaccagatcaaggccaacaccaagaaggagttcgacgagtggttcaagcccttcagcgacaagctgcagctgagaagcaccctgaccaacagcgccagcctgtgcgacagagtgcccgacctggccctggccgagatgaagatggccctggccaccgacgacaaggagaaggacagcatcttcagcaacgccctggtggaggccaccagattctgcgcccccatctacgagtgcgcctggacctgcagcaccggcgtggtgcagaagagcctgagctggttcgacaagaacaaggacttcatcaagctgtgggacgccaagtacatggacctgagaaagggcatccccgagcccgagcagctggtgagctaccagcaggccgcccagaagtggagaaaggacatcggctacgagatcaaccagttcaccagaagcctgacccaccccgtggtggccgagtacaaggtgcccggcgagatcgccgtggacgtgaaggagatgctgagcgacatgatcagaagaagaaacgtgctgctgaacggcgacggcgagaacgccggcaagaagggccccatcagcagagagcacgtgagctggggcagagagctggccggcggcaagttccaggtggtgttcaaccccccctggggcgacatcaacaagtgcggcaagagcggcatccccctggccgccaccgccatggtgaaggtggccgagctggacggcagcaagaagctggaggacatcagacaggccctgctggacctgaagaagtggatcgaggacaacaaggacgccctggaggacggcaagggcaacgagctgatccagaccatgaccaagcacctggcccaggccgtggagctgagcaagaagagcaacgccctgagagcccagggcgcccagatcgacacccccttcagcgccttctactgggcctggagcgccggcgtgaagcccgagaccttcttcaccctgagccagttcctgttcgagatgggccagagcgccagaggcggcaagaagatgatcaaggccctgaccagcacccccctgagatggggcaagggcctgatcaacctgttcgccgacgacgacttcagcggcaacagactgtacatgcaccccgccgtgctgacccccggcagaatgagcgagatgggcgcctgcttcggcgtgatccccgtggccagccccgaggacgccatcctgggcagcggccacagcaagaacatcctgaacttcaagatcgacaccagcgtgcagaacccctgcgccagcaccatcgtgcagctgtacagaatccagaagagcggcttcgacctggagagcctggaggtggtgagcaccgagcacctgctgcaccagagcttcgtgggcaagagatgccccacccagaacgcctacaaggtgagaggcaacgccaccaacgtgaacatcatctga

SEQ ID NO: 5353 - RNA, 1452 nt, synthetic construct
  misc_feature 1..1452: note = derived and/or modified CDS sequence (opt4) from DUGV(NJT130)__FJ422213.2__N
  source 1..1452: mol_type = other RNA
atggagaaccagatcaaggccaacaacaagaaggagttcgacgagtggttcaagcccttcagcgacaagctgcagctgagaagcaccctgaccaacagcgccagcctgtgcgacaaggtgcccgacctggccctggccgagatgaagatggccctggccaccgacgacaaggagaaggacagcatcttcagcaacgccctggtggaggccaccagattctgcgcccccatctacgagtgcgcctggacctgcagcaccggcgtggtgcagaagagcctgagctggttcgacaagaacaaggacttcatcaagctgtgggacgccaagtacatggacctgagaaagggcatccccgagcccgagcagctggtgagctaccagcaggccgcccagaagtggagaaaggacatcggctacgagatcaaccagttcaccagaagcctgacccaccccgtggtggccgagtacaaggtgcccggcgagatcgccgtggacgtgaaggagatgctgagcgacatgatcagaagaagaaacgtgctgctgaacggcgacggcgagaacgccggcaagaagggccccatcagcagagagcacgtgagctggggcagagagctggccgagggcaagttccaggtggtgttcaaccccccctggggcgacatcaacaagtgcggcaagagcggcatccccctggccgccaccgccatggtgaaggtggccgagctggacggcagcaagaagctggaggacatcagacaggccctgctggacctgaagaagtgggtggaggacaacaaggacgccctggaggacggcaagggcaacgagctgatccagaccatgaccaagcacctggcccaggccgtggagctgagcaagaagagcaacgccctgagagcccagggcgcccagatcgacacccccttcagcgccttctactgggcctggagcgccggcgtgaagcccgagaccttcttcaccctgagccagttcctgttcgagatgggccagagcgccagaggcggcaagaagatgatcaaggccctgaccagcacccccctgagatggggcaagggcctgatcaacctgttcgccgacgacgacttcagcggcaacagactgtacatgcaccccgccgtgctgacccccggcagaatgagcgagatgggcgcctgcttcggcgtgatccccgtggccagccccgaggacgccatcctgggcagcggccacagcaagaacatcctgaacttcaagatcgacaccagcgtgcagaacccctgcgccagcaccatcgtgcagctgtacagaatccagaagagcggcttcgacctggagagcctggaggtggtgagcaccgagcacctgctgcaccagagcttcgtgggcaagagatgccccacccagaacgcctacaaggtgagaggcaacgccaccaacgtgaacatcatctga

SEQ ID NO: 5354 - RNA, 1452 nt, synthetic construct
  misc_feature 1..1452: note = derived and/or modified CDS sequence (opt4) from DUGV(IbAr1792)__KU925457.1__N
  source 1..1452: mol_type = other RNA
atggagaaccagatcaaggccaacaacaagaaggagttcgacgagtggttcaagcccttcagcgagaagctgcagctgagaagcaacctgaccaacagcgccagcctgtgcgacagagtgcccgacctggccctggccgagatgaagatggccctggccaccgacgacaaggagaaggacagcatcttcagcaacgccctggtggaggccaccagattctgcgcccccatctacgagtgcgcctggacctgcagcaccggcgtggtgcagaagagcctgagctggttcgacaagaacaaggacttcatcaagctgtgggacgccaagtacatggacctgagaaagggcatccccgagcccgagcagctggtgagctaccagcaggccgcccagaagtggagaaaggacgtgggctacgagatcaaccagttcaccagaagcctgacccaccccgtggtggccgagtacaaggtgcccggcgagatcgccgtggacgtgaaggagatgctgagcgacatgatcagaagaagaaacgtgctgctgaacggcgacggcgagaacgccggcaagaagggccccatcagcagagagcacgtgagctggggcagagagctggccggcggcaagttccaggtggtgttcaaccccccctggggcgacatcaacaagtgcggcaagagcggcatccccctggccgccaccgccatggtgaaggtggccgagctggacggcagcaagaagctggaggacatcagacaggccctgctggacctgaagaagtgggtggaggacaacaaggacgccctggaggacggcaagggcaacgagctggtgcagaccatgaccaagcacctggcccaggccgtggagctgagcaagaagagcaacgccctgagagcccagggcgcccagatcgacacccccttcagcgccttctactgggcctggagcgccggcgtgaagcccgagaccttcttcaccctgagccagttcctgttcgagatgggccagaacgccagaggcggcaagaagatgatcaaggccctgaccagcacccccctgagatggggcaagggcctgatcaacctgttcgccgacgacgacttcctgggcaacagactgtacatgcaccccgccgtgctgacccccggcagaatgagcgagatgggcgcctgcttcggcgtgatccccgtggccagccccgaggacgccatcctgggcagcggccacagcaagaacatcctgaacttcaagatcgacaccagcgtgcagaacccctgcgccagcaccatcgtgcagctgtacagaatccagaagagcggcttcgacctggagagcctggaggtggtgagcaccgagcacctgctgcaccagagcttcgtgggcaagagatgccccacccagaacgcctacaaggtgagaggcaacgccaccaacgtgaacatcatctga

SEQ ID NO: 5355 - RNA, 1449 nt, synthetic construct
  misc_feature 1..1449: note = derived and/or modified CDS sequence (opt4) from NSDV(Jilin)__NC_034386.1__N
  source 1..1449: mol_type = other RNA
atgcagaaccagatcgtggccgacaacaaggacgccatcctggcctggcacaagacctacagcgagaagcacagactgaagagcgtgctgaccaacagcgccagcttctgcgagaccatccccgacctgagcggctacgaggtgagcatgagactggtgagcagcgagagcgagaaggacagcgtgtacgccagcgccctggtggccgccaccaagttctgcgcccccatcctggagtgcgcctggaccagctgcaccggcatggtggagagaggcctggactggttcgagaacaacaaggagaccgtgaagatctgggacgccgagtacggcaagctgagaaccgaggcccccagccccgagcagctgctgggctaccagagagccgccctgaagtggagaaaggacaccaagtacggcatcaacagaaacaccgccgccctggccgccgccatcgccaccgagtacagagtgcccggcagcatcgtggtgaacgtgaaggacatgctgagcgacatgatcagaagaagaaacaagatcctgaacagagacggcagcgaggacgtgcccaagagaggccccgtgagcaaggagcacatcgactgggccagagacctggcccagggcaagttcctggtggtgttcaaccccccctggggcgacatcaacaaggccggcaagagcggcatcgccctggccgccaccggcatggccaagctgatcgagctggacggccccaagatcgccgaggacctgagagagagcctgaagggcctggtggcctggatcaacgcccacaaggacgaggtggagaacggcaaggaggtggtggacggcctgaccaagcacctgcagaaggccctggagctggccaagcagagcagcgccatgagagcccagggcgcccagatcgacaccgtgttcagcagctactactggctgtggaaggccggcgtgaccgccgagatgttccccaccgtgagccagttcctgttcgagctgggcaaggtgcccagaggcaacaagaagatgaagaaggccctgagcagcatgcccctgaagtggggcaagaagctgctggccctgttcgccgacgacagcttcaccgccaacagaatctacatgcaccccggcgtgctgaccgccggcagaatgagcgagctgggcgtgtgcttcggcgccatccccgtggccaaccccgacgacgccgccgagggcagcggccacatcaagaacatcctggcccagaccaccgacacccaggccggcaacccctgcgcccagaacatcgtggccctgttcaacatccagaaggccggcttcgacatcgagagcatggacatcgtggccctggagcacctgctgcaccagagcctggtgggcaagagaagccccttccagaacgcctacaacatcagaggcaacgccaccagcatccagatcatctga

SEQ ID NO: 5356 - RNA, 1449 nt, synthetic construct
  misc_feature 1..1449: note = derived and/or modified CDS sequence (opt4) from NSDV(62873)__HQ286609.1__N
  source 1..1449: mol_type = other RNA
atgcagaaccagatcgtggccgacaacaaggacgccatcctggcctggcacaagacctacagcgagaagcacaagctgaagagcgtgctgaccaacagcgccagcttctgcgagaccatccccgacctgagcggctacgaggtgagcatgagactggtgagcagcgagagcgagaaggacagcgtgtacgccagcgccctggtggccgccaccaagttctgcgcccccatcctggagtgcgcctggaccagctgcaccggcatgatccagagaggcctggactggttcgagaacaacggcgagatggtgaagatctgggacgccgactacggcaagctgagaaccgagatccccagccccgagcagctgctgggctaccagagagccgccctgaagtggagaaaggacaccaagtacggcatcaacaagaacaccgccgccctggccgccgccatcgccaccgagtacagagtgcccggcagcatcgtggtgaacgtgaaggacatgctgagcgacatgatcagaagaagaaacaagatcctgaacagagacggcagcgaggacgtgcccaagagaggccccgtgagcaaggagcacatcgactgggccagagacctggcccagggcaagttcctggtggtgttcaaccccccctggggcgacatcaacaaggccggcaagagcggcatcgccctggccgccaccggcatggccaagctgatcgagctggacggccccaaggtggccgaggacctgaaggagagcctgaagagcctggtggcctggatcaacgcccacaaggacgaggtggagaacggcaaggaggtggtggacggcctgaccaagcacctgcagaaggccctggagctggccaagcagagcagcgccatgagagcccagggcgcccagatcgacaccgtgttcagcagctactactggctgtggaaggccggcgtgaccgccgagatgttccccaccgtgagccagttcctgttcgagctgggcaaggtgcccagaggcaacaagaagatgaagaaggccctgagcagcatgcccctgaagtggggcaagaagctgctggccctgttcgccgacgacagcttcaccgccaacagaatctacatgcaccccggcgtgctgaccgccggcagaatgagcgagctgggcgtgtgcttcggcgccatccccgtggccaaccccgacgacgccgccgagggcagcggccacatcaagaacatcctgaactacaagaccgacacccaggccggcaacccctgcgcccagaacatcgtggccctgttcaacatccagaaggccggcttcgacatcgagagcatggacatcgtggccagcgagcacctgctgcaccagagcctggtgggcaagagaagccccttccagaacgcctacaacatcagaggcaacgccaccagcatccagatcatctga

SEQ ID NO: 5357 - RNA, 1449 nt, synthetic construct
  misc_feature 1..1449: note = derived and/or modified CDS sequence (opt4) from NSDV(779)__HQ286602.1__N
  source 1..1449: mol_type = other RNA
atgcagaaccagatcgtggccgacaacaaggacgccatcctggcctggcacaagacctacagcgagaagcacaagctgaagagcgtgctgaccaacagcgccagcttctgcgagaccatccccgacctgagcggctacgaggtgagcatgagactggtgagcagcgagagcgagaaggacagcgtgtacgccagcgccctggtggccgccaccaagttctgcgcccccatcctggagtgcgcctggaccagctgcaccggcatgatccagagaggcctggactggttcgacaacaacggcgagatggtgaagatctgggacgccgactacggcaagctgagaaccgaggtgcccagccccgagcagctgctgggctaccagagagccgccctgaagtggagaaaggacaccaagtacggcatcaacaagaacaccgccgccctggccgccgccatcgccaccgagtacagagtgcccggcagcatcgtggtgaacgtgaaggacatgctgagcgacatgatcagaagaagaaacaagatcctgaacagagacggcagcgaggacgtgcccaagagaggccccgtgagcaaggagcacatcgactgggccagagacctggcccagggcaagttcctggtggtgttcaaccccccctggggcgacatcaacaaggccggcaagagcggcatcgccctggccgccaccggcatggccaagctgatcgagctggacggccccaaggtggccgaggacctgaaggagagcctgaagagcctggtggcctggatcaacgcccacaaggacgaggtggagaacggcaaggaggtggtggacggcctgaccaagcacctgcagaaggccctggagctggccaagcagagcagcgccatgagagcccagggcgcccagatcgacaccgtgttcagcagctactactggctgtggaaggccggcgtgaccgccgagatgttccccaccgtgagccagttcctgttcgagctgggcaaggtgcccagaggcaacaagaagatgaagaaggccctgagcagcatgcccctgaagtggggcaagaagctgctggccctgttcgccgacgacagcttcaccgccaacagaatctacatgcaccccggcgtgctgaccgccggcagaatgagcgagctgggcgtgtgcttcggcgccatccccgtggccaaccccgacgacgccgccgagggcagcggccacatcaagaacatcctgaactacaagaccgacacccaggccggcaacccctgcgcccagaacatcgtggccctgttcaacatccagaaggccggcttcgacatcgagagcatggacatcgtggccagcgagcacctgctgcaccagagcctggtgggcaagagaagccccttccagaacgcctacaacatcagaggcaacgccaccagcatccagatcatctga

SEQ ID NO: 5358 - RNA, 1449 nt, synthetic construct
  misc_feature 1..1449: note = derived and/or modified CDS sequence (opt4) from NSDV(6233)__HQ286603.1__N
  source 1..1449: mol_type = other RNA
atgcagaaccagatcgtggccgacaacaaggacgccatcctggcctggcacaagacctacagcgagaagcacaagctgaagagcgtgctgaccaacagcgccagcttctgcgagaccatccccgacctgagcggctacgaggtgagcatgagactggtgagcagcgagagcgagaaggacagcgtgtacgccagcgccctggtggccgccaccaagttctgcgcccccatcctggagtgcgcctggaccagctgcaccggcatgatccagagaggcctggactggttcgacaacaacggcgagatggtgaagatctgggacgccgactacggcaagctgagaaccgaggtgcccagccccgagcagctgctgggctaccagagagccgccctgaagtggagaaaggacaccaagtacggcatcaacaagaacaccgccgccctggccgccgccatcgccaccgagtacagagtgcccggcagcatcgtggtgaacgtgaaggacatgctgagcgacatgatcagaagaagaaacaagatcctgaacagagacggcagcgaggacgtgcccaagagaggccccgtgagcaaggagcacatcgactgggccagagacctggcccagggcaagttcctggtggtgttcaaccccccctggggcgacatcaacaaggccggcaagagcggcatcgccctggccgccaccggcatggccaagctgatcgagctggacggccccaaggtggccgaggacctgaaggagagcctgaagagcctggtggcctggatcaacgcccacaaggacgaggtggagaacggcaaggacgtggtggacggcctgaccaagcacctgcagaaggccctggagctggccaagcagagcagcgccatgagagcccagggcgcccagatcgacaccgtgttcagcagctactactggctgtggaaggccggcgtgaccgccgagatgttccccaccgtgagccagttcctgttcgagctgggcaaggtgcccagaggcaacaagaagatgaagaaggccctgagcagcatgcccctgaagtggggcaagaagctgctggccctgttcgccgacgacagcttcaccgccaacagaatctacatgcaccccggcgtgctgaccgccggcagaatgagcgagctgggcgtgtgcttcggcgccatccccgtggccaaccccgacgacgccgccgagggcagcggccacatcaagaacatcctgaactacaagaccgacacccaggccggcaacccctgcgcccagaacatcgtggccctgttcaacatccagaaggccggcttcgacatcgagagcatggacatcgtggccagcgagcacctgctgcaccagagcctggtgggcaagagaagccccttccagaacgcctacaacatcagaggcaacgccaccagcatccagatcatctga

SEQ ID NO: 5359 - RNA, 1449 nt, synthetic construct
  misc_feature 1..1449: note = derived and/or modified CDS sequence (opt4) from NSDV(40350)__HQ286608.1__N
  source 1..1449: mol_type = other RNA
atgcagaaccagatcgtggccgacagcaaggacgccatcctggcctggcacaagacctacagcgagaagcacaagctgaagagcgtgctgaccaacagcgccagcttctgcgagaccatccccgacctgagcggctacgaggtgagcatgagactggtgagcagcgacagcgagaaggacagcgtgtacgccagcgccctggtggccgccaccaagttctgcgcccccatcctggagtgcgcctggaccagctgcaccggcatgatccagagaggcctggactggttcgagaacaacggcgagatggtgaagatctgggacgccgactacggcaagctgagaaccgaggtgcccagccccgagcagctgctgggctaccagagagccgccctgaagtggagaaaggacaccaagtacggcatcaacaagaacaccgccgccctggccgccgccatcgccaccgagtacagagtgcccggcagcatcgtggtgaacgtgaaggacatgctgagcgacatgatcagaagaagaaacaagatcctgaacagagacggcagcgaggacgtgcccaagagaggccccgtgagcaaggagcacatcgactgggccagagacctggcccagggcaagttcctggtggtgttcaaccccccctggggcgacatcaacaaggccggcaagagcggcatcgccctggccgccaccggcatggccaagctgatcgagctggacggccccaagatcgccgaggacctgaaggagagcctgaagagcctggtggcctggatcaacgcccacaaggacgaggtggagaacggcaaggaggtggtggacggcctgaccaagcacctgcagaaggccctggagctggccaagcagagcagcgccatgagagcccagggcgcccagatcgacaccgtgttcagcagctactactggctgtggaaggccggcgtgaccgccgagatgttccccaccgtgagccagttcctgttcgagctgggcaaggtgcccagaggcaacaagaagatgaagaaggccctgagcagcatgcccctgaagtggggcaagaagctgctggccctgttcgccgacgacagcttcaccgccaacagaatctacatgcaccccggcgtgctgaccgccggcagaatgagcgagctgggcgtgtgcttcggcgccatccccgtggccaaccccgacgacgccgccgagggcagcggccacatcaagaacatcctgaactacaagaccgacacccaggccggcaacccctgcgcccagaacatcgtggccctgttcaacatccagaaggccggcttcgacatcgagagcatggacatcgtggccagcgagcacctgctgcaccagagcctggtgggcaagagaagccccttccagaacgcctacaacatcagaggcaacgccaccagcatccagatcatctga

SEQ ID NO: 5360 - RNA, 1449 nt, synthetic construct
  misc_feature 1..1449: note = derived and/or modified CDS sequence (opt4) from NSDV(616287)__HQ286605.1__N
  source 1..1449: mol_type = other RNA
atgcagaaccagatcgtggccgacaacaaggacgccatcctggcctggcacaagacctacagcgagaagcacaagctgaagagcgtgctgaccaacagcgccagcttctgcgagaccatccccgacctgagcggctacgaggtgagcatgagactggtgagcagcgagagcgagaaggacagcgtgtacgccagcgccctggtggccgccaccaagttctgcgcccccatcctggagtgcgcctggaccagctgcaccggcatgatccagagaggcctggactggttcgacaacaacggcgagatggtgaagatctgggacgccgactacggcaagctgagaaccgaggtgcccagccccgagcagctgctgggctaccagagagccgccctgaagtggagaaaggacaccaagtacggcatcaacaagaacaccgccgccctggccgccgccatcgccaccgagtacagagtgcccggcagcatcgtggtgaacgtgaaggacatgctgagcgacatgatcagaagaagaaacaagatcctgaacagagacggcagcgaggacgtgcccaagaagggccccgtgagcaaggagcacgtggactgggccagagacctggcccagggcaagttcctggtggtgttcaaccccccctggggcgacatcaacaaggccggcaagagcggcatcgccctggccgccaccggcatggccaagctgatcgagctggacggccccaaggtggccgaggacctgaaggagagcctgaagagcctggtggcctggatcaacgcccacaaggacgaggtggagaacggcaaggaggtggtggacggcctgaccaagcacctgcagaaggccctggagctggccaagcagagcagcgccatgagagcccagggcgcccagatcgacaccgtgttcagcagctactactggctgtggaaggccggcgtgaccgccgagatgttccccaccgtgagccagttcctgttcgagctgggcaaggtgcccagaggcaacaagaagatgaagaaggccctgagcagcatgcccctgaagtggggcaagaagctgctggccctgttcgccgacgacagcttcaccgccaacagaatctacatgcaccccggcgtgctgaccgccggcagaatgagcgagctgggcgtgtgcttcggcgccatccccgtggccaaccccgacgacgccgccgagggcagcggccacatcaagaacatcctgaactacaagaccgacacccaggccggcaacccctgcgcccagaacatcgtggccctgttcaacatccagaaggccggcttcgacatcgagagcatggacatcgtggccagcgagcacctgctgcaccagagcctggtgggcaagagaagccccttccagaacgcctacaacatcagaggcaacgccaccagcatccagatcatctga

SEQ ID NO: 5361 - RNA, 1449 nt, synthetic construct
  misc_feature 1..1449: note = derived and/or modified CDS sequence (opt4) from NSDV(615526)__HQ286606.1__N
  source 1..1449: mol_type = other RNA
atgcagaaccagatcgtggccgacaacaaggacgccatcctggcctggcacaaggcctacagcgagaagcacaagctgaagagcgtgctgaccaacagcgccagcttctgcgagaccatccccgacctgagcggctacgaggtgagcatgagactggtgagcagcgagagcgagaaggacagcgtgtacgccagcgccctggtggccgccaccaagttctgcgcccccatcctggagtgcgcctggaccagctgcaccggcatgatccagagaggcctggactggttcgacagcaacggcgagatggtgaagatctgggacgccgactacggcaagctgagaaccgaggtgcccagccccgagcagctgctgggctaccagagagccgccctgaagtggagaaaggacaccaagtacggcatcaacaagaacaccgccgccctggccgccgccatcgccaccgagtacagagtgcccggcagcatcgtggtgaacgtgaaggacatgctgagcgacatgatcagaagaagaaacaagatcctgaacagagacggcagcgaggacgtgcccaagggcggccccgtgagcaaggagcacatcgactgggccagagacctggcccagggcaagttcctggtggtgttcaaccccccctggggcgacatcaacaaggccggcaagagcggcatcgccctggccgccaccggcatggccaagctgatcgagctggacggccccaagatcgccgaggacctgaaggagagcctgaagagcctggtggcctggatcaacgcccacaaggacgaggtggagaacggcaaggaggtggtggacggcctgaccaagcacctgcagaaggccctggagctggccaagcagagcagcgccatgagagcccagggcgcccagatcgacaccgtgttcagcagctactactggctgtggaaggccggcgtgaccgccgagatgttccccaccgtgagccagttcctgttcgagctgggcaaggtgcccagaggcaacaagaagatgaagaaggccctgagcagcatgcccctgaagtggggcaagaagctgctggccctgttcgccgacgacagcttcaccgccaacagaatctacatgcaccccggcgtgctgaccgccggcagaatgagcgagctgggcgtgtgcttcggcgccatccccgtggccaaccccgacgacgccgccgagggcagcggccacatcaagaacatcctgaactacaagaccgacacccaggccggcaacccctgcgcccagaacatcgtggccctgttcaacatccagaaggccggcttcgacatcgagagcatggacatcgtggccagcgagcacctgctgcaccagagcctggtgggcaagagaagccccttccagaacgcctacaacatcagaggcaacgccaccagcatccagatcatctga

SEQ ID NO: 5362 - RNA, 1449 nt, synthetic construct
  misc_feature 1..1449: note = derived and/or modified CDS sequence (opt4) from NSDV(708)__AF504293.1__N
  source 1..1449: mol_type = other RNA
atgcagaaccagatcgtggccgacaacaaggacgccatcctggcctggcacaaggcctacagcgagaagcacaagctgaagagcgtgctgaccaacagcgccagcttctgcgaggccatccccgacctgagcggctacgaggtgagcatgagactggtgagcagcgacagcgagaaggacagcgtgtacgccagcgccctggtggccgccaccaagttctgcgcccccatcctggagtgcgcctggaccagctgcaccggcatggtggagagaggcctggactggttcgagaacaacagagagatggtgaagatctgggacaccgagtacggcaagctgagaaccgaggtgcccagccccgagcagctgctgggctaccagagagccgccctgaagtggagaaaggacaccaagtacggcatcaacaagaacaccgccgccctggccgccgccatcgccaccgagtacaaggtgcccggcagcctggtggtgaacgtgaaggacatgctgagcgacatgatcagaagaagaaacaagatcctgaacagagacggcagcgaggacgtgcccaagagaggccccgtgagcaaggagcacatcgactgggccagagacctggcccagggcaagttcctggtggtgttcaaccccccctggggcgacatcaacaaggccggcaagagcggcatcgccctggccgccaccggcatggccaagctgatcgagctggacggccccaagatcgccgaggacctgaaggagagcctgaagagcctggtggcctggatcaacgcccacaaggacgaggtggagaacggcaaggaggtggtggacagcctgaccaagtacctgcagaaggccctggagctggccaagcagagcagcgccatgagagcccagggcgcccagatcgacaccgtgttcagcagctactactggctgtggaaggccggcgtgaccgccgagatgttccccaccgtgagccagttcctgttcgagctgggcaaggtgcccagaggcaacaagaagatgaagaaggccctgagcagcatgcccctgaagtggggcaagaagctgctggccctgttcgccgacgacagcttcaccgccaacagaatctacatgcaccccggcgtgctgaccgccggcagaatgagcgagctgggcgtgtgcttcggcgccatccccgtggccaaccccgacgacgccgccgacggcagcggccacatcaagagcatcctgaactacaagaccgacacccaggccggcaacccctgcgcccagaacatcgtggccctgttcaacatccagaaggccggcttcgacatcgagagcatggacatcgtggccagcgagcacctgctgcaccagagcctggtgggcaagagaagccccttccagaacgcctacaacatcagaggcaacgccaccagcatccagatcatctga

SEQ ID NO: 5363 - RNA, 702 nt, synthetic construct
  misc_feature 1..702: note = derived and/or modified CDS sequence (opt4) from BUNV__NC_001927.1__N
  source 1..702: mol_type = other RNA
atgatcgagctggagttccacgacgtggccgccaacaccagcagcaccttcgaccccgaggtggcctacgccaacttcaagagagtgcacaccaccggcctgagctacgaccacatcagaatcttctacatcaagggcagagagatcaagaccagcctggccaagagaagcgagtgggaggtgaccctgaacctgggcggctggaagatcaccgtgtacaacaccaacttccccggcaacagaaacaaccccgtgcccgacgacggcctgaccctgcacagactgagcggcttcctggccagatacctgctggagaagatgctgaaggtgagcgagcccgagaagctgatcatcaagagcaagatcatcaaccccctggccgagaagaacggcatcacctggaacgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccgccacctggaccgtgagcaagctgaccgaggtgcagagcgccctgaccgtggtgagcagcctgggctggaagaagaccaacgtgagcgccgccgccagagacttcctggccaagttcggcatcaacatgtga

SEQ ID NO: 5364 - RNA, 702 nt, synthetic construct
  misc_feature 1..702: note = derived and/or modified CDS sequence (opt4) from BUNV(SFCrEq231)__KP063894.1__N
  source 1..702: mol_type = other RNA
atgatcgagctggagttcaacgacgtggccgccaacaccagcagcaccttcgaccccgaggtggcctacatcaacttcaagagaatctacaccaccggcctgagctacgaccacatcagaatcttctacatcaagggcagagagatcaagaccagcctgaccaagagaagcgagtgggaggtgaccctgaacctgggcggctggaaggtgaccgtgttcaacaccaacttccccggcaacagaaacagccccgtgcccgacgacggcctgaccctgcacagactgagcggcttcctggccagatacctgctggagaagatcctgaaggtgagcgagcccgagaagctgatcatcaagagcaagatcatcaaccccctggccgagaagaacggcatcacctggagcgacggcgaggaggtgtacctgagcttcttccccggcagcgagatgttcctgggcaccttcaagttctaccccctggccatcggcatctacaaggtgcagagaaaggagatggagcccaagtacctggagaagaccatgagacagagatacatgggcctggaggccagcacctggaccgtgagcaaggtgaacgaggtgcagagcgccctgaccgtggtgagcggcctgggctggaagaagaccaacgtgagcgccgccgccagagagttcctggccaagttcggcatcaacatgtga

SEQ ID NO: 5365 - RNA, 702 nt, synthetic construct
  misc_feature 1..702: note = derived and/or modified CDS sequence (opt4) from BUNV(AMH001130)__JF961342.1__N
  source 1..702: mol_type = other RNA
atgatcgagctggagttccacgacgtggccgccaacaccagcagcaccttcgaccccgaggtggcctacgccaacttcaagagagtgcacaccaccggcctgagctacgaccacatcagaatcttctacatcaagggcagagaggtgaagaccagcctggccaagagaagcgagtgggaggtgaccctgaacctgggcggctggaagatcaccgtgtacaacaccaacttccccggcaacagaaacaaccccgtgcccgacgacggcctgaccctgcacagactgagcggcttcctggccagatacctgctggagaagatgctgaaggtgagcgagcccgagaagctgatcatcaagagcaagatcatcaaccccctggccgagaagaacggcatcacctggaacgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccgccacctggaccgtgagcaagctgaccgaggtgcagagcgccctgaccgtggtgagcagcctgggctggaagaagaccaacgtgagcgccgccgccagagacttcctggccaagttcggcatcaacatgtga

SEQ ID NO: 5366 - RNA, 702 nt, synthetic construct
  misc_feature 1..702: note = derived and/or modified CDS sequence (opt4) from BUNV(ArB29051)__AM709778.1__N
  source 1..702: mol_type = other RNA
atgatcgagctggagttccacgacgtggccgccaacaccagcagcaccttcgaccccgaggtggcctacgccaacttcaagagagtgcacaccaccggcctgagctacgaccacatcagaatcttctacatcaagggcagagagatcaagaccagcctggccaagagaagcgagtgggaggtgaccctgaacctgggcggctggaagatcaccgtgtacaacaccaacttccccggcaacagaaacaaccccgtgcccgacgacggcctgaccctgcacagactgagcggcttcctggccagatacctgctggagaagatgctgaagctgagcgagcccgagaagctgatcatcaagagcaagatcatcaaccccctggccgagaagaacggcatcacctggaacgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccgccacctggaccgtgagcaagctgaccgaggtgcagagcgccctgaccgtggtgagcagcctgggctggaagaagaccaacgtgagcgccgccgccagagacttcctggccaagttcggcatcaacatgtga

SEQ ID NO: 5367 - RNA, 702 nt, synthetic construct
  misc_feature 1..702: note = derived and/or modified CDS sequence (opt4) from BUNV(ArB28215)__AM711130.1__N
  source 1..702: mol_type = other RNA
atgatcgagctggagttcaacgacgtggccgtgaacaccagcagcagcttcgaccccgaggccgcctacgccaacttcaagagagtgcacaccaccggcctgagctacgaccacatcagaatcttctacatcaagggcagagagatcaaggtgagcctgagcaagagaagcgagtgggaggtgaccatcaacctgggcggctggaagatcgccgtgtacaacaccaacttccccggcaacagaaacagccccgtgcccgacgacggcctgaccctgcacagactgagcggcttcctggccagattcctgctggagaagatgctgaagatgagcgagcccgagaagctgatcatcaaggccaagatcatcaaccccctggccgagaagaacagaatcacctggaacgacggcgaggaggtgtacctgagcttcttccccggcagcgagatgttcctgggcaccttcaagttctaccccctggccatcggcatctacaaggtgcagagaaaggagatggagcccaagtacttcgagaagaccatgagacagagatacatgggcctggaggccagcagctggaccgtgagcaagctgaccgacgtgcagagcgccctgaccgtggtgagcggcctgggctggaagaagaccaacgtgagcgccgccgccagagacttcctggccaagttcggcatcaacatgtga

SEQ ID NO: 5368 - RNA, 702 nt, synthetic construct
  misc_feature 1..702: note = derived and/or modified CDS sequence (opt4) from BUNV(Peurto Almendras)__AJ697960.1__N
  source 1..702: mol_type = other RNA
atgagcgagatcgccttcgacgacatcggccagatcgccgccagcaccttcaaccccgacaaccagtacatcggcttcaagaaggtgttcaccatcggcctgacctacgaccagatcagaatcttcttcctgaacggcaagaaggccaaggagaccctgagcaagagaagcgaggagaccgtgaccctgaacttcggcggctggagaatccccatcgtgaacacccacttccccggcaacagaaacatcgacctggccgacgacgccctgaccctgcacagagtgagcggctacctggccagatacctgctggagaaggtgctgagcgcccaggagcccgagaaggtgatcatcaagaccagaatcatcaaccccatcgccgccagcaacggcatcacctgggacgacggctacgaggtgtacctgagcttcttccccggcagcgagtgcttcctggaggccttcaagttctaccccctggccatcggcatctacaaggtgcagaagggcatgatggacgtgaagttcctggagaagaccatgagacagaagtacgccggcctggacgccaccgtgtggacccagcagaagtacaccgacgtgatcaacgccctgctggtggtgaacggcctgggctggaagaagagcaacgtgagcgccgccgccaaggacttcctgagcaagttcggcatccagatctga

SEQ ID NO: 5369 - RNA, 702 nt, synthetic construct
  misc_feature 1..702: note = derived and/or modified CDS sequence (opt4) from BUNV__AF325122.1__N
  source 1..702: mol_type = other RNA
atgatcgagctggagttcaacgacgtggccgccaacaccagcagcaccttcgaccccgaggtggcctacatcaacttcaagagactgtacaccaccggcctgagctacgaccacatcagaatcttctacatcaagggcagagagatcaagaccagcctggccaagagaagcgagtgggaggtgaccctgaacctgggcggctggaaggtgaccgtgttcaacaccaacttccccggcaacagaaacagccccgtgcccgacgacggcctgaccctgcacagactgagcggctacctggccagatacctgctggagaagatcctgaaggtgagcgaccccgagaagctgatcatcaagagcaagatcatcaaccccctggccgagaagaacggcatcacctggagcgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccagcacctggaccgtgagcaagctgaacgaggtgcagagcgccctgaccgtggtgagcggcctgggctggaagaagaccaacgtgagcagcgccgccagagagttcctggccaagttcggcatcagcatgtga

SEQ ID NO: 5370 - RNA, 702 nt, synthetic construct
  misc_feature 1..702: note = derived and/or modified CDS sequence (opt4) from Ab-BUNV(Cu20-XJ)__KJ710424.1__N
  source 1..702: mol_type = other RNA
atgctggagctggagttcgaggacgtgcccaccaacatcggcagcaccttcgaccccgagagcggctacatcaacttccagagaaactacctgcccggcgtgaccctggaccagatcagaatcttctacatcaagggcagagagatcaagaacagcctggccaagagaagcgagtgggaggtgaccctgaacctgggcggctggaaggtgcccgtgctgaacaccaacttccccggcaacagaagcaacgccgtgcccgactacggcctgaccttccacagaatcagcggctacctggccagatacctgctgggcaagtacctggccgagaccgagcccgagaagctgatcatgagaaccaagatcatcaaccccctggccgagaagaacggcatcacctgggagagcggccccgaggtgtacctgagcttcttccccggcgccgagatgttcctgggcaccttcaagttctaccccctggccatcggcatctacaaggtgcagagaaaggagatggaccccaagttcctggagaagaccatgagacagagatacctgggcctggacgcccagacctggaccaccaccaagctggacgaggtggagagagccctgaaggtggtgagcggcctgggctggaagaagaccaacgtgagcaacgccgccagagagttcctgagcaagttcggcatcagaatgtga

SEQ ID NO: 5371 - RNA, 702 nt, synthetic construct
  misc_feature 1..702: note = derived and/or modified CDS sequence (opt4) from ANADV(2513 Irkutsk)__KT313716.1__N
  source 1..702: mol_type = other RNA
atgatcgagctggagttcaacgacgtggccgccaacaccagcagcaccttcgaccccgaggtggcctacatcaacttcaagagaatctacaccaccggcctgagctacgaccacatcagaatcttctacatcaagggcagagagatcaagaccagcctggccaagagaagcgagtgggaggtgaccctgaacctgggcggctggaaggtgaccgtgttcaacaccaacttccccggcaacagaaacagccccgtgcccgacgacggcctgaccctgcacagactgagcggcttcctggccagatacctgctggagaagatcctgaaggtgagcgaccccgagaagctgatcatcaagagcaagatcatcaaccccctggccgagaagaacggcatcacctgggccgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccagcacctggaccgtgagcaagctgaacgaggtgcagagcgccctgaccgtggtgagcggcctgggctggaagaagaccaacgtgagcagcgccgccagagagttcctggccagattcggcatcaacatgtga

SEQ ID NO: 5372 - RNA, 702 nt, synthetic construct
  misc_feature 1..702: note = derived and/or modified CDS sequence (opt4) from ANADV(EIV-23263Tyum)__KT313761.1__N
  source 1..702: mol_type = other RNA
atgatcgagctggagttcaacgacgtggccgccaacaccagcagcaccttcgaccccgaggtggcctacatcaacttcaagagaatctacaccaccggcctgagctacgaccacatcagaatcttctacatcaagggcagagagatcaagaccagcctggccaagagaagcgagtgggaggtgaccctgaacctgggcggctggaagatcaccgtgttcaacaccaacttccccggcaacagaaacagccccgtgcccgacgacggcctgaccctgcacagactgagcggcttcctggccagatacctgctggagaagatcctgaaggtgagcgaccccgagaagctgatcatcaagagcaagatcatcaaccccctggccgagaagaacggcatcacctgggccgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccagcacctggaccgtgagcaagctgaacgaggtgcagagcgccctgaccgtggtgagcggcctgggctggaagaagaccaacgtgagcagcgccgccagagagttcctggccagattcggcatcaacatgtga

SEQ ID NO: 5373 - RNA, 702 nt, synthetic construct
  misc_feature 1..702: note = derived and/or modified CDS sequence (opt4) from BATV__X73464.1__N
  source 1..702: mol_type = other RNA
atgatcgagctggagttcaacgacgtggccgccaacaccagcagcaccttcgaccccgaggtggcctacatcaacttcaagagaatctacaccaccggcctgagctacgacaacatcagaatcttctacatcaagggcagagagatcaagaccagcctgagcaagagaagcgagtgggaggtgaccctgaacctgggcggctggaaggtgaccgtgttcaacaccaacttccccggcaacagaaacagccccgtgcccgacgacggcctgaccctgcacagactgagcggcttcctggccagatacctgctggagaagatcctgaaggtgagcgaccccgagaagctgatcatcaagagcaagatcgtgaaccccctggccgagaagaacggcatcacctgggccgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccagcacctggaccgtgagcaagctgaacgaggtgcagagcgccctgaccgtggtgagcggcctgggctggaagaagaccaacgtgagcagcgccgccagagagttcctggccaagttcggcatcagcatgtga

SEQ ID NO: 5374 - RNA, 702 nt, synthetic construct
  misc_feature 1..702: note = derived and/or modified CDS sequence (opt4) from BATV(668)__KT313687.1__N
  source 1..702: mol_type = other RNA
atgatcgagctggagttcaacgacgtggccgccaacaccagcagcaccttcgaccccgaggtggcctacctgaacttcaagagaatctacaccaccggcctgagctacgacaacatcagaatcttctacatcaagggcagagagatcaaggtgagcctggccaagagaagcgagtgggaggtgaccctgaacctgggcggctggaaggtgaccgtgttcaacaccaacttccccggcaacagaaacagccccgtgcccgacgacggcctgaccctgcacagactgagcggcttcctggccagatacctgctggagaagatcctgaaggtgagcgaccccgagaagctgatcatcaagagcaagatcatcaaccccctggccgagaagaacggcatcacctggagcgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccagcacctggaccgtgagcaagctgaacgaggtgcagagcgccctgaccgtggtgagcggcctgggctggaagaagaccaacgtgagcagcgccgccagagagttcctggccaagttcggcatcaacatgtga

SEQ ID NO: 5375 - RNA, 702 nt, synthetic construct
  misc_feature 1..702: note = derived and/or modified CDS sequence (opt4) from BATV(804922)__FJ436805.1__N
  source 1..702: mol_type = other RNA
atgatcgagctggagttcaacgacgtggccgccaacaccagcagcaccttcgaccccgaggtggcctacatcaacttcaagagaatctacaccaccggcctgagctacgacaacatcagaatcttctacatcaagggcagagagatcaagaccagcctggccaagagaagcgagtgggaggtgaccctgaacctgggcggctggaaggtgaccgtgttcaacaccaacttccccggcaacagaaacagccccgtgcccgacgacggcctgaccctgcacagactgagcggcttcctggccagatacctgctggagaagatcctgaaggtgagcgaccccgagaagctgatcatcaagagcaagatcgtgaaccccctggccgagaagaacggcatcacctgggccgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccagcacctggaccgtgagcaagctgaacgaggtgcagagcgccctgaccgtggtgagcggcctgggctggaagaagaccaacgtgagcagcgccgccagagagttcctggccaagttcggcatcagcatgtga

SEQ ID NO: 5376 - RNA, 702 nt, synthetic construct
  misc_feature 1..702: note = derived and/or modified CDS sequence (opt4) from BATV(8627-11)__FJ436802.1__N
  source 1..702: mol_type = other RNA
atgatcgagctggagttcaacgacgtggccgccaacaccagcagcaccttcgaccccgaggtggcctacatcaacttcaagagaatctacaccaccggcctgagctacgacaacatcagaatcttctacatcaagggcagagagatcaagaccagcctggccaagagaagcgagtgggaggtgaccctgaacctgggcggctggaaggtgaccgtgttcaacaccaacttccccggcaacagaaacagccccgtgcccgacgacggcctgaccctgcacagactgagcggcttcctggccagatacctgctggagaagatcctgaaggtgagcgaccccgagaagctgatcatcaagagcaagatcgtgaaccccctggccgagaagaacggcatcacctgggccgacggcgaggaggtgtacctgagcttcttccccggcagcgagatgttcctgggcaccttcagattctaccccctggccatcggcatctacaaggtgcagagaaaggagatggagcccaagtacctggagaagaccatgagacacagatacatgggcctggaggccagcacctggaccgtgagcaagctgaacgaggtgcagagcgccctgaccgtggtgagcggcctgggctggaagaagaccaacgtgagcagcgccgccagagagttcctggccaagttcggcatcagcatgtga

SEQ ID NO: 5377 - RNA, 702 nt, synthetic construct
  misc_feature 1..702: note = derived and/or modified CDS sequence (opt4) from BATV(G-20217)__FJ436806.1__N
  source 1..702: mol_type = other RNA
atgatcgagctggagttcaacgacgtggccgccaacaccagcagcaccttcgaccccgaggtggcctacatcaacttcaagagaatctacaccaccggcctgagctacgacaacatcagaatcttctacatcaagggcagagagatcaagaccagcctggccaagagaagcgagtgggaggtgaccctgaacctgggcggctggaaggtgaccgtgttcaacaccaacttccccggcaacagaaacagccccgtgcccgacgacggcctgaccctgcacagactgagcggcttcctggccagatacctgctggagaagatcctgaaggtgagcgaccccgagaagctgatcatcaagagcaagatcgtgaaccccctggccgagaagaacggcatcacctgggccgacggcgaggaggtgtacctgagcttcttccccggcagcgagatgttcctgggcaccttcagattctaccccctgagcatcggcatctacaaggtgcagagaaaggagatggagcccaagtacctggagaagaccatgagacagagatacatgggcctggaggccagcacctggaccgtgagcaagctgaacgaggtgcagagcgccctgaccgtggtgagcggcctgggctggaagaagaccaacgtgagcagcgccgccagagagttcctggccaagttcggcatcagcatgtga

SEQ ID NO: 5378 - RNA, 702 nt, synthetic construct
  misc_feature 1..702: note = derived and/or modified CDS sequence (opt4) from BATV(MS50)__JX846604.1__N
  source 1..702: mol_type = other RNA
atgatcgagctggagttcaacgacgtggccgccaacaccagcagcaccttcgaccccgaggtggcctacgccaacttcaagagagtgcacaccaccggcctgagctacgaccacgtgagaatcttctacatcaagggcagagagatcaagaccagcctgagcaagagaagcgagtgggaggtgaccctgaacctgggcggctggaagatcgccgtgtacaacaccaacttccccagcaacagaaacaaccccgtgcccgacgacggcctgaccctgcacagactgagcggctacctggccagatacctgttcgagaagatcgtgaaggtgagcgagcccgagaagctgctgatcaagagcaagatcatcaaccccctggccgagaagaacggcatcacctgggccgacggcgaggagatctacctgagcttcttccccggcagcgagatgttcctgggcaccttcaagttctaccccctggccatcggcatctacaaggtgcagagaaaggagatggagcccaagtacctggagaagaccatgagacagagatacatgggcctggaggccggcacctggaccgtgagcaaggtgaacgaggtgcaggccgccgtgaacgtggtgagcaccctgggctggaagaagaccaacgtgagcgccgccgccagagagttcctggccaagttcggcatcgccatgtga

SEQ ID NO: 5379 - RNA, 702 nt, synthetic construct
  misc_feature 1..702: note = derived and/or modified CDS sequence (opt4) from BATV(ON-1/E/94)__AB257761.1__N
  source 1..702: mol_type = other RNA
atgatcgagctggagttcaacgacgtggccgccaacaccagcagcaccttcgaccccgaggtggcctacatcaacttcaagagagtgtacaccaccggcctgagctacgacaacatcagaatcttctacatcaagggcagagagatcaagaccagcctggccaagagaagcgagtgggaggtgaccctgaacctgggcggctggaaggtgaccgtgttcaacaccaacttccccggcaacagaaacagccccgtgcccgacgacggcctgaccctgcacagactgagcggcttcctggccagatacctgctggagaagatcctgaaggtgagcgaccccgagaagctgatcatcaagagcaagatcgtgaaccccctggccgagaagaacggcatcacctgggccgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccagcacctggaccgtgagcaagctgaacgaggtgcagagcgccctgaccgtggtgagcggcctgggctggaagaagaccaacgtgagcagcgccgccagagagttcctggccaagttcggcatcagcatgtga

SEQ ID NO: 5380 - RNA, 702 nt, synthetic construct
  misc_feature 1..702: note = derived and/or modified CDS sequence (opt4) from BATV(UgMP-6830)__JX846601.1__N
  source 1..702: mol_type = other RNA
atgatcgagctggagttcaacgacgtggccgccaacaccagcagcaccttcgaccccgaggtggcctacatcaacttcaagagaatctacaccaccggcctgagctacgacaacatcagaatcttctacatcaagggcagagagatcaagaccagcctggccaagagaagcgagtgggaggtgaccctgaacctgggcggctggaaggtgaccgtgttcaacaccaacttccccggcaacagaaacagccccgtgcccgacgacggcctgaccctgcacagactgagcggcttcctggccagatacctgctggagaagatcctgaaggtgagcgaccccgagaagctgatcatcaagagcaagatcatcaaccccctggccgagaagaacggcatcacctgggccgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccagcacctggaccgtgagcaagctgaacgaggtgcagagcgccctgaccgtggtgagcggcctgggctggaagaagaccaacgtgagcagcgccgccagagagttcctggccaagttcggcatcagcatgtga

SEQ ID NO: 5381 - RNA, 702 nt, synthetic construct
  misc_feature 1..702: note = derived and/or modified CDS sequence (opt4) from BIRV(ArB2198)__AM711131.1__N
  source 1..702: mol_type = other RNA
atgatcgagctggagttccaccacgtggccgccaacaccagcagcaccttcgaccccgaggtggcctacgccaacttcaagagaatccacaccaacggcctgagctacgacaacatcagaatcttctacatcaagggcagagagatcaagaccagcctggccaagagaagcgagtgggaggtgaccctgaacctgggcggctggaaggtggccgtgtacaacaccaacttccccggcaacagaaacaaccccgtgcccgacgacggcctgaccctgcacagactgagcggcttcctggccagatacctgctggagaagatgctgaaggtgagcgagcccgagaagctgatcatcaagaccaagatcatcaaccccctggccgagaagaacggcatcacctggaaggacggcgaggaggtgtacctgagcttcttccccggcagcgagatgttcctgggcaccttcaagttctaccccctggccatcggcatctacaaggtgcagaagaaggagatggaccccaagtacctggagaagaccatgagacagagatacatgggcctggaggccagcacctggaccgtgagcaaggtgagcgaggtgcagagcgccctgaccgtggtgagcagcctgggctggaagaagaccaacgtgaccgccgccgccagagacttcttcgccaagttcggcatcaacatgtga

SEQ ID NO: 5382 - RNA, 702 nt, synthetic construct
  misc_feature 1..702: note = derived and/or modified CDS sequence (opt4) from BOZOV(ArB13529)__AM711132.1__N
  source 1..702: mol_type = other RNA
atgatcgagctggagttcaacgacgtggccgccaacaccagcagcaccttcgaccccgaggccgcctacgccaacttcaagagagtgcacaccaccggcctgacctacgaccacatcagaatcttctacatcaagggcagcgagatcaagaccagcctggccaagagaagcgagtgggaggtgaccctgaacctgggcggctggaagatcaccgtgtacaacaccaacttccccggcaacagaaacaaccccagccccgacgacggcctgaccctgcacttcttctgcggcttcctggccaagagcctgctggagaagatgctgaaggtgagcgcccccgagaagctgatcatcaagagcaagatcaccagccccctggccgagaagaacggcatcacctggaacgacggcgaggaggtgtacctgagcttcttccccggcagcgagatgttcctgggcaccttccacttctaccccctgcccatcggcatctaccagggcctgagaagagacctggagcccaagtacttcggcaagaccctgagactgatgtacatgggcctggaggccagcagctggaccgtgagcaagctgaccgagggccagagcgccctgaccgtggtgagcggcctgggctggaagaagaccaacgtgagcgccgccgccagagacttcctggccaagttcggcatcaacatgtga

SEQ ID NO: 5383 - RNA, 702 nt, synthetic construct
  misc_feature 1..702: note = derived and/or modified CDS sequence (opt4) from CVV__X73465.1__N
  source 1..702: mol_type = other RNA
atgatcgagctggagttcaacgacgtggccgccaacaccagcagcaccttcgaccccgagatcgcctacgtgaacttcaagagaatccacaccaccggcctgagctacgaccacatcagaatcttctacatcaagggcagagagatcaagaccagcctgaccaagagaagcgagtgggaggtgaccctgaacctgggcggctggaaggtgaccgtgttcaacaccaacttccccggcaacagaaacagccccgtgcccgacgacggcctgaccctgcacagactgagcggctacctggccagatacctgctggagaagatcctgaaggtgagcgaccccgagaaggtgatcatcaagagcaagatcatcaaccccctggccgagaagaacggcatcacctggagcgacggcgaggaggtgtacctgagcttcttccccggcagcgagatgttcctgggcaccttcaagttctaccccctggccatcggcatctacaaggtgcagagaaaggagatggagcccaagtacctggagaagaccatgagacagagatacatgggcctggaggccagcacctggaccatcagcaaggtgaacgaggtgcaggccgccctgaccgtggtgagcggcctgggctggaagaagaccaacgtgagcgccgccgccagagagttcctggccaagttcggcatcagcatgtga

SEQ ID NO: 5384 - RNA, 702 nt, synthetic construct
  misc_feature 1..702: note = derived and/or modified CDS sequence (opt4) from CVV(10081)__KP835932.1__N
  source 1..702: mol_type = other RNA
atgatcgagctggagttcaacgacgtggccgccaacaccagcagcaccttcgaccccgagatcgcctacgtgaacttcaagagaatctacaccaccggcctgagctacgaccacatcagaatcttctacatcaagggcagagagatcaagaccagcctgaccaagagaagcgagtgggaggtgaccctgaacctgggcggctggaagatcaccgtgttcaacaccaacttccccggcaacagaaacagccccgtgcccgacgacggcctgaccctgcacagactgagcggctacctggccagatacctgctggagaagatcctgaaggtgagcgaccccgagaaggtgatcatcaagagcaagatcatcaaccccctggccgagaagaacggcatcacctggagcgacggcgaggaggtgtacctgagcttcttccccggcagcgagatgttcctgggcaccttcaagttctaccccctggccatcggcatctacaaggtgcagagaaaggagatggagcccaagtacctggagaagaccatgagacagagatacatgggcctggaggccagcacctggaccatcagcaaggtgaacgaggtgcaggccgccctgaccgtggtgagcggcctgggctggaagaagaccaacgtgagcgccgccgccagagagttcctggccaagttcggcatcagcatgtga

SEQ ID NO: 5385 - RNA, 702 nt, synthetic construct
  misc_feature 1..702: note = derived and/or modified CDS sequence (opt4) from CHLV(CHLV-Mex07)__EU879062.3__N
  source 1..702: mol_type = other RNA
atgatcgagctggagttcaacgacgtggccgccaacaccagcagcaccttcgaccccgagatcgcctacgtgaacttcaagagaatctacaccaccggcctgagctacgaccacatcagaatcttctacatcaagggcagagagatcaagaccagcctgaccaagagaagcgagtgggaggtgaccctgaacctgggcggctggaaggtgaccgtgttcaacaccaacttccccggcaacagaaacagccccgtgcccgacgacggcctgaccctgcacagactgagcggctacctggccagatacctgctggagaagatcctgaaggtgagcgaccccgagaaggtgatcatcaagagcaagatcatcaaccccctggccgagaagaacggcatcacctggagcgacggcgaggaggtgtacctgagcttcttccccggcagcgagatgttcctgggcaccttcaagttctaccccctggccatcggcatctacaaggtgcagagaaaggagatggagcccaagtacctggagaagaccatgagacagagatacatgggcctggaggccagcacctggaccgtgagcaaggtgaacgaggtgcaggccgccctgaccgtggtgagcggcctgggctggaagaagaccaacgtgagcgccgccgccagagagttcctggccaagttcggcatcagcatgtga

SEQ ID NO: 5386 - RNA, 702 nt, synthetic construct
  misc_feature 1..702: note = derived and/or modified CDS sequence (opt4) from GERV__M19420.1__N
  source 1..702: mol_type = other RNA
atgctggagctggagttcgaggacgtgcccaacaacatcggcagcaccttcgaccccgagagcggctacaccaacttccagagaaactacctgcccggcgtgaccctggaccagatcagaatcttctacatcaagggcagagagatcaagaacagcctgagcaagagaagcgagtgggaggtgaccctgaacctgggcggctggaaggtgcccgtgctgaacaccaacttccccggcaacagaaacaacgccgtgcccgactacggcctgaccttccacagaatcagcggctacctggccagatacctgctgggcaagtacctggccgagaccgagcccgagaagctgatcatgagaaccaagatcgtgaaccccctggccgagaagaacggcatcacctgggagagcggccccgaggtgtacctgagcttcttccccggcgccgagatgttcctgggcaccttcagattctaccccctggccatcggcatctacaaggtgcagagaaaggagatggaccccaagttcctggagaagaccatgagacagagatacctgggcatcgacgcccagacctggaccaccaccaagctgggcgaggtggaggccgccctgaaggtggtgagcggcctgggctggaagaagaccaacgtgagcagcgccgccagagagttcctgagcaagttcggcatcagaatgtga

SEQ ID NO: 5387 - RNA, 702 nt, synthetic construct
  misc_feature 1..702: note = derived and/or modified CDS sequence (opt4) from IACOV(BeAn314206)__JN572067.1__N
  source 1..702: mol_type = other RNA
atgagcgagatcatcttcgacgacgtgggccagatcaccagcagcaccttcaaccccgacgtgcagtacatcaacttcaagaagaaccacaccaccggcctgaactacgaccagatcagagtgttcttcctgaacggcaagaaggccaaggagaccctggccaagagaagcgaggagagcctgcagctgaacttcggcggctggagagtggtggtgatgaacacccacttccccggcaacagaaacatgctgatccccgacgaggccatgaccctgcacagactgagcggctacctggccagatacctgctggagagaatcctgagcggccccgagcacgagaaggtggtgatcaccagcaagatcgtgaaccccatcgccgccagcaacggcatcacctggaccgacggccccgaggtgtacctgagcttcttccccggcaccgagatgttcctggagagcttcaagttctaccccctggccatcggcatctacaaggtgcagaagaagatgatggagagcaagtacctggagaaggccatgagacagaagtacagcggcatggacgccaccctgtggacccagcagaagtacgccgaggtgaccaacgccctggccgtggtgagcaacctgggctggaagaagagcaacgtgagcgccgccgccagagacttcctggccaagttcggcatccagctgtga

SEQ ID NO: 5388 - RNA, 702 nt, synthetic construct
  misc_feature 1..702: note = derived and/or modified CDS sequence (opt4) from ILEV(ArB16282)__AM709780.1__N
  source 1..702: mol_type = other RNA
atgatcgagctggagttccacgacgtgaccgccaacaccagcagcaccttcgaccccgaggtggcctacgccaacttcaagagaatccacaccaacggcctgaactacgaccacatcagaatcttctacatcaagggcagagagatcaagaccagcctggccaagagaagcgagtgggaggtgaccctgaacctgggcggctggaagatcagcgtgtacaacaccaagttccccggcaacagaaacaaccccgtgcccgacgacggcctgaccctgcacagactgagcggcttcctggccagatacctgctggagaagatgctgaaggtgagcgagcccgagaagctgatcatcaagagcaagatcatcaaccccctggccgagaagaacggcatcacctggtacgacggcgaggaggtgtacctgagcttcttccccggcagcgagatgtgcctgggcacccaggacttctaccccatggccatcgagttctaccaggtgcagagaaaggagatggagcccaagttcctggagaagaccctgaagcagagaagcctgggcctggagcccagcacctggaccatcagccagctggtgaagctgcagagcgccctgaccgtggtgagcggcctgggctggaagaagaccaacgtgggcgccgccgccagaaacttcctggccaagttcggcatcaacatgtga

SEQ ID NO: 5389 - RNA, 702 nt, synthetic construct
  misc_feature 1..702: note = derived and/or modified CDS sequence (opt4) from ILEV(HB80P125)__AM709779.1__N
  source 1..702: mol_type = other RNA
atgatcgagctggagttccacgacgtgaccgccaacaccagcagcaccttcgaccccgaggtggcctacgccaacttcaagagaatccacaccaacggcctgaactacgaccacatcagaatcttctacatcaagggcagagagatcaagaccagcctggccaagagaagcgagtgggaggtgaccctgaacctgggcggctggaagatcgccgtgtacaacaccaacttccccggcaacagaaacaaccccgtgcccgacgacggcctgaccctgcacagactgagcggctacctggccagatgcctgctggagaagatgctgaaggtgagcgagcccgagaagcagatcatcaagagcaagatcatcaaccccctggccgagaagaacggcatcacctgggacgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccagcacctggaccatcagcaagctggccgaggtgcagagcgccctgaccgtggtgagcggcctgggctggaagaagaccaacgtgagcgccgccgccagagacttcctggccaagttcggcatcaacatgtga

SEQ ID NO: 5390 - RNA, 702 nt, synthetic construct
  misc_feature 1..702: note = derived and/or modified CDS sequence (opt4) from ILEV(ILESHA/8e)__KC608151.1__N
  source 1..702: mol_type = other RNA
atgatcgagctggagttccacgacgtgaccgccaacaccagcagcaccttcgaccccgaggtggcctacgccaacttcaagagaatccacaccaacggcctgaactacgaccacatcagaatcttctacatcaagggcagagagatcaagaccagcctggccaagagaagcgagtgggaggtgaccctgaacctgggcggctggaagatcgccgtgtacaacaccaacttccccggcaacagaaacaaccccatccccgacgacggcctgaccctgcacagactgagcggctacctggccagatacctgctggagaagatgctgaaggtgagcgagcccgagaagcagatcatcaagagcaagatcatcaaccccctggccgagaagaacggcatcacctgggacgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccagcacctggaccatcagcaagctggccgaggtgcagagcgccctgaccgtggtgagcggcctgggctggaagaagaccaacgtgagcgccgccgccagagacttcctggccaagttcggcatcaacatgtga

SEQ ID NO: 5391 - RNA, 702 nt, synthetic construct
  misc_feature 1..702: note = derived and/or modified CDS sequence (opt4) from ILEV(R5964)__AY729651.1__N
  source 1..702: mol_type = other RNA
atgatcgagctggagttccacgacgtgaccgccaacaccagcagcaccttcgaccccgaggtggcctacgccaacttcaagagaatccacaccaacggcctgaactacgaccacatcagaatcttctacatcaagggcagagagatcaagaccagcctggccaagagaagcgagtgggaggtgaccctgaacctgggcggctggaagatcgccgtgtacaacaccaacttccccggcaacagaaacaaccccatccccgacgacggcctgaccctgcacagactgagcggctacctggccagatacctgctggagaagatgctgaaggtgagcgagcccgagaagcagatcatcaagagcaagatcatcaaccccctggccgagaagaacggcatcacctgggacgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccagcacctggaccatcagcaagctggccgaggtgcagagcgccctgaccgtggtgagcggcctgggctggaagaagaccaacgtgagcgcccccgccagagacttcctggccaagttcggcatcaacatgtga

SEQ ID NO: 5392 - RNA, 702 nt, synthetic construct
  misc_feature 1..702: note = derived and/or modified CDS sequence (opt4) from MAGV__D13783.1__N
  source 1..702: mol_type = other RNA
atgatcgagctggagttcaacgacgtggccgccaacaccagcagcaccttcgaccccgagatcgcctacgtgaacttcaagagaatccacaccaccggcctgagctacgaccacatcagagtgctgtacatcaagggcagagagatcaagaccagcctgaccaagagaagcgagtgggaggtgaccctgaacctgggcggctggaaggtggccgtgttcaacaccaacttccccggcaacagaaacagccccgtgcccgacgacggcctgaccctgcacagactgagcggcttcctggccagatacctgctggagaagatcctgaaggtgagcgaccccgagaagctgatcatcaagagcaagatcatcaaccccctggccgagaagaacggcatcacctgggccgacggcgaggaggtgtacctgagcttcttccccggcagcgagatgttcctgggcaccttcaagttctaccccctggccatcggcatctacaaggtgcagaagaaggagatggagcccaagtacctggagaagaccatgagacagagatacatgggcctggaggccgccacctggaccgtgagcaaggtgaacgaggtgcaggccgccctgaccgtggtgagcggcctgggctggaagaagaccaacgtgagcgccgccgccagagagttcctggccaagttcggcatcaacatgtga

SEQ ID NO: 5393 - RNA, 702 nt, synthetic construct
  misc_feature 1..702: note = derived and/or modified CDS sequence (opt4) from MAGV(7272)__KX100103.1__N
  source 1..702: mol_type = other RNA
atgatcgagctggagttcaacgacgtggccgccaacaccagcagcaccttcgaccccgagatcgcctacgtgaacttcaagagaatccacaccaccggcctgagctacgaccacatcagagtgctgtacatcaagggcagagagatcaagaccagcctgaccaagagaagcgagtgggaggtgaccctgaacctgggcggctggaaggtggccgtgttcaacaccaacttccccggcaacagaaacagccccgtgcccgacgacggcctgaccctgcacagactgagcggcttcctggccagatacctgctggagaagatcctgaaggtgagcgaccccgagaagctgatcatcaagagcaagatcatcaaccccctggccgagaagaacggcatcacctgggccgacggcgaggaggtgtacctgagcttcttccccggcagcgagatgttcctgggcaccttcaagttctaccccctggccatcggcatctacaaggtgcagagaaaggagatggagcccaagtacctggagaagaccatgagacagagatacatgggcctggaggccgccacctggaccgtgagcaaggtgaacgaggtgcaggccgccctgaccgtggtgagcggcctgggctggaagaagaccaacgtgagcgccgccgccagagagttcctggccaagttcggcatcaacatgtga

SEQ ID NO: 5394 - RNA, 702 nt, synthetic construct
  misc_feature 1..702: note = derived and/or modified CDS sequence (opt4) from MAGV(3363)__KX100106.1__N
  source 1..702: mol_type = other RNA
atgatcgagctggagttcaacgacgtggccgccaacaccagcagcaccttcgaccccgagatcgcctacgtgaacttcaagagaatctacaccaccggcctgagctacgaccacatcagaatcttctacatcaagggcagagagatcaagaccagcctgaccaagagaagcgagtgggaggtgaccctgaacctgggcggctggaaggtgaccgtgttcaacaccaacttccccggcaacagaaacagccccgtgcccgacgacggcctgaccctgcacagactgagcggctacctggccagatacctgctggagaagatcctgaaggtgagcgaccccgagaaggtgatcatcaagagcaagatcatcaaccccctggccgagaagaacggcatcacctggagcgacggcgaggaggtgtacctgagcttcttccccggcagcgagatgttcctgggcaccttcaagttctaccccctggccatcggcatctacaaggtgcagagaaaggagatggagcccaagtacctggagaagaccatgagacagagatacatgggcctggaggccagcacctggaccatcagcaaggtgaacgaggtgcaggccgccctgaccgtggtgagcggcctgggctggaagaagaccaacgtgagcgccgccgccagagagttcctggccaagttcggcatcagcatgtga

SEQ ID NO: 5395 - RNA, 702 nt, synthetic construct
  misc_feature 1..702: note = derived and/or modified CDS sequence (opt4) from NRIV(DakArY357/6e)__AY593727.1__N
  source 1..702: mol_type = other RNA
atgatcgagctggagttccacgacgtgaccgccaacaccagcagcaccttcgaccccgaggtggcctacgccaacttcaagagaatccacaccaacggcctgaactacgactacatcagaatcttctacatcaagggcagagagatcaagaccagcctggccaagagaagcgagtgggaggtgaccctgaacctgggcggctggaagatcgccgtgtacaacaccaacttccccggcaacagaaacaaccccatccccgacgacggcctgaccctgcacagactgagcggctacctggccagatacctgctggagaagatgctgaaggtgagcgagcccgagaagcagatcatcaagagcaagatcatcaaccccctggccgagaagaacggcatcacctgggacgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccagcacctggaccatcagcaagctggccgaggtgcagagcgccctgaccgtggtgagcggcctgggctggaagaagaccaacgtgagcgccgccgccagagacttcctggccaagttcggcatcaacatgtga

SEQ ID NO: 5396 - RNA, 702 nt, synthetic construct
  misc_feature 1..702: note = derived and/or modified CDS sequence (opt4) from NORV__X73470.1__N
  source 1..702: mol_type = other RNA
atgatcgagctggagttcaacgacgtggccgccaacaccagcagcaccttcgaccccgaggtggcctacatcaacttcaagagagtgtacaccaccggcctgagctacgaccacatcagaatcttctacatcaagggcagagagatcaagaccagcctgaccaagagaagcgagtgggaggtgaccctgaacctgggcggctggaaggtgaccgtgttcaacaccaacttccccggcaacagaaacagccccgtgcccgacgacggcctgaccctgcacagactgagcggcttcctggccagatacctgctggagaagatcctgaaggtgagcgagcccgagaagctgatcatcaagagcaagatcatcaaccccctggccgagaagaacggcatcacctggaccgacggcgaggaggtgtacctgagcttcttccccggcagcgagatgttcctgggcaccttcaagttctaccccctggccatcggcatctacaaggtgcagagaaaggagatggagcccaagtacctggagaagaccatgagacagagatacatgggcctggaggccagcacctggaccatcagcaaggtgaacgaggtgcaggccgccctgaccgtggtgagcggcctgggctggaagaagaccaacgtgagcgccgccgccagagagttcctggccaagttcggcatcaacatgtga

SEQ ID NO: 5397 - RNA, 702 nt, synthetic construct
  misc_feature 1..702: note = derived and/or modified CDS sequence (opt4) from POTV(89-3380)__AY729652.1__N
  source 1..702: mol_type = other RNA
atgatcgagctggagttcaacgacgtggccgccgacaccagcagcaccttcgaccccgagatcgcctacgtgaacttcaagagaatccacaccaccggcctgagctacgaccacatcagaatcttctacatcaagggcagagagatcaagaccagcctgaccaagagaagcgagtgggaggtgaccctgaacctgggcggctggaagatcaccgtgttcaacaccaacttccccggcaacagaaacagccccgtgcccgacgacggcctgaccctgcacagactgagcggctacctggccagatacctgctggagaagatcctgaaggtgagcgaccccgagaaggtgatcatcaagagcaagatcatcaaccccctggccgagaagaacggcatcacctggagcgacggcgaggaggtgtacctgagcttcttccccggcagcgagatgttcctgggcaccttcaagttctaccccctggccatcggcatctacaaggtgcagagaaaggagatggagcccaagtacctggagaagaccatgagacagagatacatgggcctggaggccagcacctggaccgtgagcaaggtgaacgaggtgcaggccgccctgaccgtggtgagcggcctgggctggaagaagaccaacgtgagcgccgccgccagagagttcctggccaagttcggcatcagcatgtga

SEQ ID NO: 5398 - RNA, 702 nt, synthetic construct
  misc_feature 1..702: note = derived and/or modified CDS sequence (opt4) from SHOV(4042)__EU564831.1__N
  source 1..702: mol_type = other RNA
atgatcgagctggagttccacgacgtggccgccaacaccagcagcaccttcgaccccgaggtggcctacgccaacttcaagagagtgcacaccaccggcctgagctacgaccacatcagaatcttctacatcaagggcagagagatcaagaccagcctggccaagagaagcgagtgggaggtgaccctgaacctgggcggctggaagatcaccgtgtacaacaccaacttccccggcaacagaaacaaccccgtgcccgacgacggcctgaccctgcacagactgagcggcttcctggccagatacctgctggagaagatgctgaaggtgagcgagcccgagaagctgatcatcaagagcaagatcatcaaccccctggccgagaagaacggcatcacctggaccgacggcgaggaggtgtacctgagcttcttccccggcgccgagatgttcctgggcaccttcaagttctaccccctggccatcggcatctacaaggtgcagagaaaggagatggagcccaagtacctggagaagaccatgagacagagatacatgggcctggaggccgccacctggaccgtgagcaagctgaccgaggtgcaggccgccctgaccgtggtgagcggcctgggctggaagaagaccaacgtgagcgccgccgccagagacttcctggccaagttcggcatcagcatgtga

SEQ ID NO: 5399 - RNA, 702 nt, synthetic construct
  misc_feature 1..702: note = derived and/or modified CDS sequence (opt4) from TENV(TSV-FE3-66FB)__FJ943505.1__N
  source 1..702: mol_type = other RNA
atgatcgagctggagttcaacgacgtggccgccaacaccagcagcaccttcgaccccgaggtgggctacgtgaacttcaagagagtgcacaccaccggcctgagctacgaccacatcagaatcttctacatcaagggcagagagatcaagaccagcctgaccaagagaagcgagtgggaggtgaccctgaacctgggcggctggaaggtgaccgtgttcaacaccaacttccccggcaacagaaacagccccgtgcccgacgacggcctgaccctgcacagactgagcggcttcctggccagatacctgctggagaagatcctgaaggtgagcgaccccgagaagctgatcatcaagagcaagatcatcaaccccctggccgagaagaacggcatcacctgggccgacggcgaggaggtgtacctgagcttcttccccggcagcgagatgttcctgggcaccttcaagttctaccccctggccatcggcatctacaaggtgcagagaaaggagatggagcccaagtacctggagaagaccatgagacagagatacatgggcctggaggccgccacctggaccatcagcaaggtgaacgaggtgcagagcgccctgaccgtggtgagcggcctgggctggaagaagaccaacgtgagcgccgccgccagagagttcctggccaagttcggcatcaacatgtga

SEQ ID NO: 5400 - RNA, 702 nt, synthetic construct
  misc_feature 1..702: note = derived and/or modified CDS sequence (opt4) from XINV(BeH388464)__EU564830.1__N
  source 1..702: mol_type = other RNA
atgctggagctggagttcaacgacgtggccgccaacaccagcagcaccttcgaccccgaggtgggctacgccaacttcaagagaatccacaccaacggcctgagctacgacaacatcagaatcttctacatcaagggcagagagatcaagaccagcctggccaagagaagcgagtgggaggtgaccctgaacctgggcggctggaagatcaccgtgtacaacaccaacttccccggcaacagaaaccaccccatccccgacgacggcctgaccatccacagactgagcggctacctggccagatacctgctggagaagatcctgaaggtgagcgaccccgagaagctgctgatcaagaccaagatcatcaaccccctggccgagaagaacggcatcacctggaacgacggcgaggaggtgtacctgagcttcttccccggcagcgagatgttcctgggcaccttcaagttctaccccctggccatcggcatctacaaggtgcagagaaaggagatggagcccaagtacctggagaaggccatgagacagagatacatgggcctggagagcgccacctggaccgtgagcaagctgaacgaggtgcagagcgccctgaccgtggtgagcggcctgggctggaagaagaccaacgtgagcgccgccgccagagagttcctggccaagttcggcatcaacatgtga

SEQ ID NO: 5401 - RNA, 702 nt, synthetic construct; identical to SEQ ID NO: 5363
  misc_feature 1..702: note = derived and/or modified CDS sequence (opt4) from NRIV(9800535)__JX857328.1__N
  source 1..702: mol_type = other RNA

SEQ ID NO: 5402 - RNA, 702 nt, synthetic construct
  misc_feature 1..702: note = derived and/or modified CDS sequence (opt4) from NRIV(Adrar)__KJ716848.1__N
  source 1..702: mol_type = other RNA
atgatcgagctggagttccacgacgtggccgccaacaccagcagcaccttcgaccccgaggtggcctacgccaacttcaagagaatctacaccaccggcctgagctacgaccacatcagaatcttctacatcaagggcagagagatcaagaccagcctggccaagagaagcgagtgggaggtgaccctgaacctgggcggctggaagatcaccgtgtacaacaccaacttccccggcaacagaaacaaccccgtgcccgacgacggcctgaccctgcacagactgagcggcttcctggccagatacctgctggagaagatgctgaaggtgagcgagcccgagaagctgatcatcaagagcaagatcatcaaccccctggccgagaagaacggcatcacctggaacgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccgccacctggaccgtgagcaagctgaccgaggtgcagagcgccctgaccgtggtgagcagcctgggctggaagaagaccaacgtgagcgccgccgccagagacttcctggccaagttcggcatcaacatgtga

SEQ ID NO: 5403 - RNA, 702 nt, synthetic construct
  misc_feature 1..702: note = derived and/or modified CDS sequence (opt4) from NRIV(D28542/4e)__KC608154.1__N
  source 1..702: mol_type = other RNA
atgatcgagctggagttccacgacgtggccgccaacaccagcagcaccttcgaccccgaggtggcctacgccaacttcaagagagtgtacaccaccggcctgagctacgaccacatcagaatcttctacatcaagggcagagagatcaagaccagcctggccaagagaagcgagtgggaggtgaccctgaacctgggcggctggaagatcaccgtgtacaacaccaacttccccggcaacagaaacaaccccgtgcccgacgacggcctgaccctgcacagactgagcggcttcctggccagatacctgctggagaagatgctgaaggtgagcgagcccgagaagctgatcatcaagagcaagatcatcaaccccctggccgagaagaacggcatcacctggaacgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccgccacctggaccgtgagcaagctgaccgaggtgcagagcgccctgaccgtggtgagcagcctgggctggaagaagaccaacgtgagcgccgccgccagagacttcctggccaagttcggcatcaacatgtga

SEQ ID NO: 5404 - RNA, 702 nt, synthetic construct
  misc_feature 1..702: note = derived and/or modified CDS sequence (opt4) from NRIV(SUD-HKV141)__JX857322.1__N
  source 1..702: mol_type = other RNA
atgatcgagctggagttccacgacgtggccgccaacaccagcagcaccttcgaccccgaggtggcctacgccaacttcaagagagtgcacaccaccggcctgagctacgaccacatcagaatcttctacatcaagggcagagagatcaagaccagcctggccaagagaagcgagtgggaggtgaccctgaacctgggcggctggaaggtgaccgtgtacaacaccaacttccccggcaacagaaacaaccccgtgcccgacgacggcctgaccctgcacagactgagcggcttcctggccagatacctgctggagaagatgctgaaggtgagcgagcccgagaagctgatcatcaagagcaagatcatcaaccccctggccgagaagaacggcatcacctggaacgacggcgaggaggtgtacctgagcttcttccccggcagcgagatgttcctgggcaccttcagattctaccccctggccatcggcatctacaaggtgcagagaaaggagatggagcccaagtacctggagaagaccatgagacagagatacatgggcctggaggccgccacctggaccgtgagcaagctgaccgaggtgcagagcgccctgaccgtggtgagcagcctgggctggaagaagaccaacgtgagcgccgccgccagagacttcctggccaagttcggcatcaacatgtga

SEQ ID NO: 5405 - RNA, 705 nt, synthetic construct
  misc_feature 1..705: note = derived and/or modified CDS sequence (opt4) from BWAV(M459)__NC_034480.1__N
  source 1..705: mol_type = other RNA
atgagcgacctgatcttctacgacgtggacagcgtgaacgccaacgagttcgaccccgacaccggctacctggacttcaagaacaactaccccggcgccctgaacaccaacaccgccagaaccttcttcctgaacgccgccaaggccaagaacgtgctgagaaacaagcccgacaagaaggtgaaccccaagttcggcaactgggaggtggaggtggtgaacaaccacttccccggcaacagaaacaaccccatcggcaaggacgacctgaccctgcacagaatcagcggctacctggccagatggatcctggaggagtacaagagagacgacgagagcgagaaggagatcatcgagagcaccgtgatcaaccccatcgccgagagcaacggcatcagatggagcgacggcgccgagatctacctgagcttcttccccggcaccgagatgttcctggagcccttcaagttctaccccctggccatcggcatctacagagtgaagcacaagatgatggacgcccagttcctgaagaaggccctgagacagagatacggcaagatgaccgccgagaagtggatgagcaccaaggtgaagaccatcggcgaggccgtgagaaacgtggagaagctgaagtggggcaagggcggcctgagcgacgccgccagaaacttcctgaagaagttcgacatcgccatgatctga

SEQ ID NO: 5406 - RNA, 705 nt, synthetic construct
  misc_feature 1..705: note = derived and/or modified CDS sequence (opt4) from BWAV(M459)__EU564827.1__N
  source 1..705: mol_type = other RNA
atgagcgacctgatcttctacgacgtggacagcgtgaacgccaacgagttcgaccccgacaccggctacctggacttcaagaacaactaccccggcgccctgaacaccaacaccgccagaaccttcttcctgaacgccgccaaggccaagaacgtgctgagaaacaagcccgacaagaaggtgaaccccaagttcggcaactgggaggtggaggtggtgaacaaccacttccccggcaacagaaacaaccccatcggcaaggacgacctgaccctgcacagaatcagcggctacctggccagatggatcctggaggagtacaagagagacgacgagagcgagaaggagatcatcgagagcaccgtgatcaaccccatcgccgagagcaacggcatcagatggagcgacggcgccgagatctacctgagcttcttccccggcaccgagatgttcctggagcccttcaagttctaccccctggccatcggcatctacagagtgaagcacaagatgatggacgcccagttcctgaagaaggccctgagacagagatacggcaagatgaccgccgagaagtggatgagcaccaaggtgaaggccatcggcgaggccgtgagaaacgtggagaagctgaagtggggcaagggcggcctgagcgacgccgccagaaacttcctgaagaagttcgacatcgccatgatctga

SEQ ID NO: 5407 - RNA, 705 nt, synthetic construct
  misc_feature 1..705: note = derived and/or modified CDS sequence (opt4) from BWAV(UgAr1888)__KJ867185.1__N
  source 1..705: mol_type = other RNA
atgagcgacctgatcttctacgacgtggacagcgtgaacgccaacgagttcgaccccgacaccggctacctggacttcaagaacaactaccccggcgccctgaacaccaacaccgccagaaccttcttcctgaacgccgccaaggccaagaacgtgctgagaaacaagcccgacaagaaggtgaaccccaagttcggcaactgggaggtggagatcgtgaacaaccacttccccggcaacagaaacaaccccatcggcaaggacgacctgaccctgcacagaatcagcggctacctggccagatggatcctggaggagtacaagagagacgacgagagcgagaaggagatcatcgagagcaccgtgatcaaccccatcgccgagagcaacggcatcagatggagcgacggcgccgagatctacctgagcttcttccccggcaccgagatgttcctggagcccttcaagttctaccccctggccatcggcatctacagagtgaagcacaagatgatggacgcccagttcctgaagaaggccctgagacagagatacggcaagatgaccgccgagaagtggatgagcaccaaggtgaaggccatcggcgaggccgtgagaaacgtggagaagctgaagtggggcaagggcggcctgagcgacgccgccagaaacttcctgaagaagttcgacatcgccatgatctga

SEQ ID NO: 5408 - RNA, 708 nt, synthetic construct
  misc_feature 1..708: note = derived and/or modified CDS sequence (opt4) from BWAV/PGAV(SAAr1)__EU564828.1__N
  source 1..708: mol_type = other RNA
atgagcggcgacctggtgttctacgacgtggacagcgtgaacagcaacgccttcgaccccgacgccggctacgtggccttcagcaacaaccaccccggcgccctgaacatcaccaccgccagaaccttcttcctgaacgccgccaaggccaagggcgtgctgagaaacaagcccgacaagaaggtgaagcccaagttcggcgactgggaggtggagatcgtgaacaaccacttccccggcaacagaaacaacaccatcggcgaggacgacctgaccctgcacagaatcagcggctacctggccagatgggtgctggaggagcacagcaaggacgacgagagcgagaaggagctgatcgagagcaccatcgtgaaccccatcgccgagagcaacggcatcaagtggagcgacggcgccgccatctacctgagcttcttccccggcaccgagatgttcctggagcccttcaagttcttccccctggccatcggcatctacagagtgaagcacaagatgatggacgcccagttcctgaagaaggccctgagacagagatacggcaagctgaccgccgagaagtggatggccaccaaggtgaagagcatcggcgaggccgtgagagccgtggagaagctgaagtggggcaagggcggcatcagcgacgccgccagaaccttcctgaagaagttcgacatcgccctgatctga

SEQ ID NO: 5409 - RNA, 708 nt, synthetic construct; identical to SEQ ID NO: 5408
  misc_feature 1..708: note = derived and/or modified CDS sequence (opt4) from BWAV/PGAV(191B-07)__KJ867179.1__N
  source 1..708: mol_type = other RNA

SEQ ID NO: 5410 - RNA, 708 nt, synthetic construct
  misc_feature 1..708: note = derived and/or modified CDS sequence (opt4) from CEV(283)__KX817314.1__N
  source 1..708: mol_type = other RNA
atgagcgacctggtgttctacgacgtggccagcaccggcgccaacggcttcgaccccgacgccggctacgtggacttctgcgccaagtacggcgagagcatcaacctggccgccgtgagaatcttcttcctgaacgccgccaaggccaaggccgccctgagcagaaagcccgagagaaaggccaaccccaagttcggcgagtggcaggtggaggtggtgaacaaccacttccccgccaacagaaacaaccccatcggcaacaacgacctgaccatccacagaatcagcggctacctggccagatgggtgctggagcagtacaaggagaacgaggacgagagccagagagagctggtgaagaccaccgtgatcaaccccatcgccgagagcaacggcatcagatgggagaacggcgccgagatctacctggccttcttccccggcaccgagatgttcctggagaccttcaagttctaccccctgaccatcggcatctacagagtgaagaacggcatgatggacagccagtacctgaagaaggccctgagacagagatacggcagcctgaccgccgagaagtggatgagccagaagaccggcatgatcgccaagagcctgaaggaggtggagcagctgaagtggggcagaggcggcctgagcgacaccgccagaaccttcctgcagaagttcggcatcaagctgccctga

SEQ ID NO: 5411 - RNA, 708 nt, synthetic construct
  misc_feature 1..708: note = derived and/or modified CDS sequence (opt4) from CEV(BFS-283)__U12797.1__N
  source 1..708: mol_type = other RNA
atgagcgacctggtgttctacgacgtggccagcaccggcgccaacggcttcgaccccgacgccggctacgtggacttctgcgccaagcacggcgagagcatcaacctggccgccgtgagaatcttcttcctgaacgccgccaaggccaaggccgccctgagcagaaagcccgagagaaaggccaaccccaagttcggcgagtggcaggtggaggtggtgaacaaccacttccccgccaacagaaacaaccccatcggcaacaacgacctgaccatccacagaatcagcggctacctggccagatgggtgctggagcagtacaaggagaacgaggacgagagccagagagagctggtgaagaccaccgtgatcaaccccatcgccgagagcaacggcatcagatgggagaacggcgccgagatctacctggccttcttccccggcaccgagatgttcctggagaccttcaagttctaccccctgaccatcggcatctacagagtgaagaacggcatgatggacagccagtacctgaagaaggccctgagacagagatacggcagcctgaccgccgagaagtggatgagccagaagaccggcatgatcgccaagagcctgaaggaggtggagcagctgaagtggggcagaggcggcctgagcgacaccgccagaaccttcctgcagaagttcggcatcaagctgccctga

SEQ ID NO: 5412 - RNA, 708 nt, synthetic construct
  misc_feature 1..708: note = derived and/or modified CDS sequence (opt4) from CHATV(Mohko ILO8-3)__KF719221.1__N
  source 1..708: mol_type = other RNA
atgagcgacctggtgttctacgacgtggccagcaccggcgccaacggcttcgaccccgacgagggctacatggccttctgcgtgaagcacgccgagagcatcagcctggccgccgtgagaatcttcttcctgaacgccgccaaggccaaggccgccctggccagaaagcccgagaagaaggccagccccaagttcggcgagtggcaggtggagatcgtgaacaaccacttccccggcaacagaaacaaccccatcggcaacaacgacctgaccgtgcacagactgagcggctacctggccagatgggtgctggagcagtacaaggagaacgaggacgagagccagagagagctgatcaagaccaccgtgatcaaccccatcgccgagagcaacggcgtgagatgggacagcggccccgagatctacctgagcttcttccccggcaccgagatgttcctggagaccttcaagttctaccccctgaccatcggcatctacagagtgaagcagggcatgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5413 - RNA, 708 nt, synthetic construct
  misc_feature 1..708: note = derived and/or modified CDS sequence (opt4) from CHATV(Mohko M07-1)__KF719224.1__N
  source 1..708: mol_type = other RNA
atgagcgacctggtgttctacgacgtggccagcaccggcgccaacggcttcgaccccgacgagggctacatggccttctgcgtgaagcacgccgagagcatcaacctggccgccgtgagaatcttcttcctgaacgccgccaaggccaaggccgccctggccagaaagcccgagaagaaggccagccccaagttcggcgagtggcaggtggagatcgtgaacaaccacttccccggcaacagaaacaaccccatcggcaacaacgacctgaccgtgcacagactgagcggctacctggccagatgggtgctggagcagtacaaggagaacgaggacgagagccagagagagctgatcaagaccaccgtgatcaaccccatcgccgagagcaacggcgtgagatgggacagcggccccgagatctacctgagcttcttccccggcaccgagatgttcctggagaccttcaagttctaccccctgaccatcggcatctacagagtgaagcagggcatgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5414 - RNA, 708 nt, synthetic construct
  misc_feature 1..708: note = derived and/or modified CDS sequence (opt4) from CHATV(Mohko S07-2)__KF719233.1__N
  source 1..708: mol_type = other RNA
atgagcgacctggtgttctacgacgtggccagcaccggcgccaacggcttcgaccccgacgagggctacatggccttctgcgtgaagcacgccgagagcatcaacctggccgccgtgagaatcttcttcctgaacgccgccaaggccaaggccgccctggccagaaagcccgagaagaaggccagccccaagttcggcgagtggcaggtggagatcgtgaacaaccacttccccggcaacagaaacaaccccatcggcaacaacgacctgaccgtgcacagactgagcggctacctggccagatgggtgctggagcagtacaaggagaacgaggacgagagccagagagagctgatcaagaccaccgtgatcaaccccatcgccgagagcaacggcgtgagatgggacagcggccccgagatctacctgagcttcttccccggcaccgagatgttcctggagaccttcaaggtgtaccccctgaccaccggcatctacagagtgaagcagggcatgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5415 - RNA, 708 nt, synthetic construct
  misc_feature 1..708: note = derived and/or modified CDS sequence (opt4) from CHATV(LEIV-11483)__FJ853592.1__N
  source 1..708: mol_type = other RNA
atgagcgacctggtgttctacgacgtggccagcaccggcgccaacggcttcgaccccgacgagggctacatggccttctgcgtgaagcacggccagagcgtgaacctggccgccgtgagaatcttcttcctgaacgccgccaaggccaaggccgccctggccagaaagcccgagaagaaggccagccccaagttcggcgagtggcaggtggagatcgtgaacaaccacttccccggcaacagaaacaaccccatcggcaacaacgacctgaccatccacagactgagcggctacctggccagatgggtgctggagcagtacaaggagaacgaggacgagagccagagagagctgatcaagaccaccgtgatcaaccccatcgccgagagcaacggcgtgagatgggacagcggcgccgagatctacctgagcttcttccccggcaccgagatgttcctggagaccttcaagttctaccccctgaccatcggcatctacagagtgaagcagggcatgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5416 - RNA, 708 nt, synthetic construct
  misc_feature 1..708: note = derived and/or modified CDS sequence (opt4) from CHATV(LEIV-11552)__EU479702.1__N
  source 1..708: mol_type = other RNA
atgagcgacctggtgttctacgacgtggccagcaccggcgccaacggcttcgaccccgacgagggctacatggccttctgcgtgaagcacggccagagcgtgaacctggccgccgtgagaatcttcttcctgaacgccgccaaggccaaggccgccctggccagaaagcccgagaagaaggccagccccaagttcggcgagtggcaggtggagatcgtgaacaaccacttccccggcaacagaaacaaccccatcggcaacaacgacctgaccatccacagactgagcggctacctggccagatggatcctggagcagtacaaggagaacgaggacgagagccagagagagctgatcaagaccaccgtgatcaaccccatcgccgagagcaacggcgtgagatgggacagcggcgccgagatctacctgagcttcttccccggcaccgagatgttcctggagaccttcaagttctaccccctgaccatcggcatctacagagtgaagcagggcatgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5417 - RNA, 708 nt, synthetic construct
  misc_feature 1..708: note = derived and/or modified CDS sequence (opt4) from CHATV(LEIV-13107)__FJ946829.1__N
  source 1..708: mol_type = other RNA
atgagcgacctggtgttctacgacgtggccagcaccggcgccaacggcttcgaccccgacgagggctacatggccttctgcgtgaagcacggccagagcgtgaacctggccgccgtgagaatcttcttcctgaacgccgccaaggccaaggccgccctggccagaaagcccgagaagaaggccaaccccaagttcggcgagtggcaggtggagatcgtgaacaaccacttccccggcaacagaaacaaccccatcggcaacaacgacctgaccatccacagactgagcggctacctggccagatgggtgctggagcagtacaaggagaacgaggacgagagccagagagagctgatcaagaccaccgtgatcaaccccatcgccgagagcaacggcgtgagatgggacagcggcgccgaggtgtacctgagcttcttccccggcaccgagatgttcctggagaccttcaagttctaccccctgaccatcggcatctacagagtgaagcagggcatgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5418 - RNA, 708 nt, synthetic construct
  misc_feature 1..708: note = derived and/or modified CDS sequence (opt4) from CHATV(LEIV-17794)__FJ913879.1__N
  source 1..708: mol_type = other RNA
atgagcgacctggtgttctacgacgtggccagcaccggcgccaacggcttcgaccccgacgagggctacatggccttctgcgtgaagcacggccagagcgtgaacctggccgccgtgagaatcttcttcctgaacgccgccaaggccaaggccgccctggccagaaagcccgagagaaaggccagccccaagttcggcgagtggcaggtggagatcgtgaacaaccacttccccggcaacagaaacaaccccatcggcaacaacgacctgaccatccacagactgagcggctacctggccagatgggtgctggagcagtacaaggagaacgaggacgagagccagagagagctgatcaagaccaccgtgatcaaccccatcgccgagagcaacggcgtgagatgggacagcggcgccgagatctacctgagcttcttccccggcaccgagatgttcctggagaccttcaagttctaccccctgaccatcggcatctacagagtgaagcagggcatgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5419 - RNA, 708 nt, synthetic construct
  misc_feature 1..708: note = derived and/or modified CDS sequence (opt4) from CHATV(LEIV-17827)__GQ330475.1__N
  source 1..708: mol_type = other RNA
atgagcgacctggtgttctacgacgtggccagcaccggcgccaacggcttcgaccccgacgagggctacatggccttctgcgtgaagtacggcgagagcatcaacctggccgccgtgagaatcttcttcctgaacgccgccaaggccaaggccgccctggccagaaagcccgagaagaaggccaaccccaagttcggcgagtggcaggtggagatcgtgaacaaccacttccccggcaacagaaacaaccccatcggcaacaacgacctgaccatccacagactgagcggctacctggccagatgggtgctggagcagtacaaggagaacgaggacgagagccagagagagctgatcaagaccaccatcatcaaccccatcgccgagagcaacggcgtgagatgggagagcggcgccgaggtgtacctgagcttcttccccggcaccgagatgttcctggagatcttcaagttctaccccctgaccatcggcatctacagagtgaagcagggcatgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5420 - RNA, 708 nt, synthetic construct
  misc_feature 1..708: note = derived and/or modified CDS sequence (opt4) from CHATV(LEIV-17829)__GQ330476.1__N
  source 1..708: mol_type = other RNA
atgagcgacctggtgttctacgacgtggccagcaccggcgccaacggcttcgaccccgacgagggctacatggccttctgcgtgaagtacggcgagagcatcaacctggccgccgtgagaatcttcttcctgaacgccgccaaggccaaggccgccctggccagaaagcccgagaagaaggccaaccccaagttcggcgagtggcaggtggagatcgtgaacaaccacttccccggcaacagaaacaaccccatcggcaacaacgacctgaccatccacagactgagcggctacctggccagatgggtgctggagcagtacaaggagaacgaggacgagagccagagagagctgatcaagaccaccatcatcaaccccatcgccgagagcaacggcgtgagatgggacagcggcgccgaggtgtacctgagcttcttccccggcaccgagatgttcctggagatcttcaagttctaccccctgaccatcggcatctacagagtgaagcagggcatgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5421 - RNA, 708 nt, synthetic construct
  misc_feature 1..708: note = derived and/or modified CDS sequence (opt4) from CHATV(LEIV-18733)__HQ734824.1__N
  source 1..708: mol_type = other RNA
atgagcgacctggtgttctacgacgtggccagcaccggcgccaacggcttcgaccccgacgagggctacatggccttctgcgtgaagtacggcgagagcatcaacctggccgccgtgagaatcttcttcctgaacgccgccaaggccaaggccgccctggccagaaagcccgagaagaaggccaaccccaagttcggcgagtggcaggtggagatcatcaacaaccacttccccggcaacagaaacaaccccatcggcaacaacgacctgaccatccacagactgagcggctacctggccagatgggtgctggagcagtacaaggagaacgaggacgagagccagagagagctgatcaagaccaccatcatcaaccccatcgccgagagcaacggcgtgagatgggacagcggcgccgaggtgtacctgagcttcttccccggcaccgagatgttcctggagatcttcaagttctaccccctgaccatcggcatctacagagtgaagcagggcatgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5422 - RNA, 708 nt, synthetic construct
  misc_feature 1..708: note = derived and/or modified CDS sequence (opt4) from CHATV(LEIV-18895)__GQ330482.1__N
  source 1..708: mol_type = other RNA
atgagcgacctggtgttctacgacgtggccagcaccggcgccaacggcttcgaccccgacgagggctacatggccttctgcgtgaagtacggcgagagcatcaacctggccgccgtgagaatcttcttcctgaacgccgccaaggccaaggccgccctggccagaaagcccgagagaaaggccaaccccaagttcggcgagtggcaggtggagatcgtgaacaaccacttccccggcaacagaaacaaccccatcggcaacaacgacctgaccatccacagactgagcggctacctggccagatgggtgctggagcagtacaaggagaacgaggacgagagccagagagagctgatcaagaccaccatcatcaaccccatcgccgagagcaacggcgtgagatgggacagcggcgccgaggtgtacctgagcttcttccccggcaccgagatgttcctggagatcttcaagttctaccccctgaccatcggcatctacagagtgaagcagggcctgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5423 - RNA, 708 nt, synthetic construct
  misc_feature 1..708: note = derived and/or modified CDS sequence (opt4) from CHATV(LEIV-22712)__HQ734825.1__N
  source 1..708: mol_type = other RNA
atgagcgacctggtgttctacgacgtggccagcaccggcgccaacggcttcgaccccgacgagggctacatggccttctgcgtgaagcacggcgagagcatcaacctggccgccgtgagaatcttcttcctgaacgccgccaaggccaaggccgccctggccagaaagcccgagaagaaggccagccccaagttcggcgagtggcaggtggagatcatcaacaaccacttccccggcaacagaaacaaccccatcggcaacaacgacctgaccatccacagactgagcggctacctggccagatgggtgctggagcagtacaaggagaacgaggacgagagccagagagagctgatcaagaccaccgtgatcaaccccatcgccgagagcaacggcgtgagatgggacagcggcgccgagatctacctgagcttcttccccggcaccgagatgttcctggagaccttcaagttctaccccctgaccatcggcatctacagagtgaagcagggcatgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5424 - RNA, 708 nt, synthetic construct
  misc_feature 1..708: note = derived and/or modified CDS sequence (opt4) from CHATV(LEIV-23500)__EU479701.1__N
  source 1..708: mol_type = other RNA
atgagcgacctggtgttctacgacgtggccagcaccggcgccaacggcttcgaccccgacgccggctacatggccttctgcgtgaagcacggcgagagcatcaacctggccgccgtgagaatcttcttcctgaacgccgccaaggccaaggccgccctggccagaaagcccgagaagaaggccaaccccaagttcggcgagtggcaggtggagatcgtgaacaaccacttccccggcaacagaaacaaccccatcggcaacaacgacctgaccatccacagactgagcggctacctggccagatgggtgctggagcagtacaaggagaacgaggacgagagccagagagagctgatcaagaccaccgtgatcaaccccatcgccgagagcaacggcgtgagatgggagaacggcgccgaggtgtacctgagcttcttccccggcaccgagatgttcctggagaccttcaagttctaccccctgaccatcggcatctacagagtgaagcagggcatgatggacccccagtacctgaagaaggccctgagacagagatacggcaccctgaccgccgacaagtggatgagccagaaggtgaccgccatcgccaagagcctgaaggaggtggagcagctgaagtggggcagaggcggcctgagcgacaccgccagaaccttcctgcagaagttcggcatcagactgccctga

SEQ ID NO: 5425 - RNA, 708 nt, synthetic construct
  misc_feature 1..708: note = derived and/or modified CDS sequence (opt4) from INKV__Z68496.1__N
  source 1..708: mol_type = other RNA
atgggcgacctggtgttctacgacgaggccagcaccggcgccaacggcttcgaccccgacgccggcttcgtggccttcatggccgaccacggcgagagcatcaacctggccgccgtgagaatcttcttcctgaacgccgccaaggccaaggccgccctggccagaaagcccgagagaaaggccacccccaagttcggcgagtggcaggtggagatcgtgaacaaccacttccccggcaacagaaacaaccccatcggcaacaacgacctgaccatccacagactgagcggctacctggccagatgggtgctggagcacttcaccgaggacgacgacgagagccagagagagctgatcagaagcaccatcatcaaccccatcgccgagagcaacggcatccactggaacaacggccccgagatctacctgagcttcttccccggcaccgagatgttcctggaggtgttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5426 - RNA, 708 nt, synthetic construct
  misc_feature 1..708: note = derived and/or modified CDS sequence (opt4) from INKV(KN3641)__U47137.1__N
  source 1..708: mol_type = other RNA
atgggcgacctggtgttctacgacgtggccagcaccggcgccaacggcttcgaccccgacgccggcttcgtggccttcatggccgaccacggcgagagcatcaacctggccgccgtgagaatcttcttcctgaacgccgccaaggccaaggccgccctggccagaaagcccgagagaaaggccacccccaagttcggcgagtggcaggtggagatcgtgaacaaccacttccccggcaacagaaacaaccccatcggcaacaacgacctgaccatccacagactgagcggctacctggccagatgggtgctggagcacttcaccgaggacgacgacgagagccagagagagctgatcagaagcaccatcatcaaccccatcgccgagagcaacggcatccactggaacaacggccccgagatctacctgagcttcttccccggcaccgagatgttcctggaggtgttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5427 - RNA, 708 nt, synthetic construct
  misc_feature 1..708: note = derived and/or modified CDS sequence (opt4) from INKV(Lovanger)__KU302751.1__N
  source 1..708: mol_type = other RNA
atgggcgacctggtgttctacgacgtggccagcaccggcgccaacggcttcgaccccgacgccggcttcgtggccttcatggccgaccacggcgagagcatcaacctggccgccgtgagaatcttcttcctgaacgccgccaaggccaaggccgccctggccagaaagcccgagagaaaggccacccccaagttcggcgagtggcaggtggagatcgtgaacaaccacttccccggcaacagaaacaaccccatcggcaacaacgacctgaccatccacagactgagcggctacctggccagatgggtgctggagcacttcaccgaggacgacgacgagagccagagagagctgatcagaagcaccatcatcaaccccatcgccgagagcaacggcatccactggaacaacggccccgagatctacctgagcttcttccccggcaccgagatgttcctggaggtgttcaagttctaccccctgaccatcggcatctacagagtgaagcacggcatgatggacccccagtacctgaagaaggccctgagacagagatacggcaccctgaccgccgagaagtggatgacccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5428 - RNA, 708 nt, synthetic construct
  misc_feature 1..708: note = derived and/or modified CDS sequence (opt4) from INKV(SW AR 83-161)__U47138.1__N
  source 1..708: mol_type = other RNA
atgggcgacctggtgttctacgacgtggccagcaccggcgccaacggcttcgaccccgacgccggcttcgtggccttcatggccgaccacggcgagagcatcaacctggccgccgtgagaatcttcttcctgaacgccgccaaggccaaggccgccctggccagaaagcccgagagaaaggccacccccaagttcggcgagtggcaggtggagatcgtgaacaaccacttccccggcaacagaaacaaccccatcggcaacaacgacctgaccatccacagactgagcggctacctggccagatgggtgctggagcacttcaccgaggacgacgacgagagccagagagagctgatcagaagcaccatcatcaaccccatcgccgagagcaacggcatccactggaacaacggccccgagatctacctgagcttcctgcccggcaccgagatgttcctggaggtgttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5429 - RNA, 708 nt, synthetic construct
  misc_feature 1..708: note = derived and/or modified CDS sequence (opt4) from LUMV__X73468.1__N
  source 1..708: mol_type = other RNA
atgagcgacctggtgttctacgacgtggccagcaccggcgccaacggcttcgaccccgacgccggctacgtggacttctgcgtgaagcacggcgagagcatcaacctgcacagcgtgagaatcttcttcctgaacgccgccaaggccaaggccgccctggccagaaagcccgagagaaaggccagccccaagttcggcgagtggcaggtggagatcgtgaacaaccacttccccggcaacagaaacaaccccatcgacaacaacgacctgaccatccacagactgagcggctacctggccagatgggtgctggagcagttcaaggagaacgaggacgccgcccagagagagctgatcaagaccaccgtgatcaaccccatcgccgagagcaacggcatcagatgggacaacggcgccgagatctacctggccttcttccccggcaccgagatgttcctggagaccttcaacttctaccccctgaccatcggcatctacagagtgaagcacggcatgatggacccccagtacctgaagaaggccctgagaagaagatacggcagcctgaccgccgacaagtggatgagccagaagaccgtggccatcgccaagagcctgaaggacgtggagcagctgaagtggggcagaggcggcctgagcgacaccgccagagtgttcctgcagaagttcggcatcaagctgccctga

SEQ ID NO: 5430 - RNA, 708 nt, synthetic construct
  misc_feature 1..708: note = derived and/or modified CDS sequence (opt4) from LUMV(SAAr 1881)__KX817326.1__N
  source 1..708: mol_type = other RNA
atgagcgacctggtgttctacgacgtggccagcaccggcgccaacggcttcgaccccgacgccggctacgtggacttctgcgtgaagcacggcgagagcatcaacctgcacagcgtgagaatcttcttcctgaacgccgccaaggccaaggccgccctggccagaaagcccgagagaaaggccagccccaagttcggcgagtggcaggtggagatcgtgaacaaccacttccccggcaacagaaacaaccccatcgacaacaacgacctgaccatccacagactgagcggctacctggccagatgggtgctggagcagttcaaggagaacgaggacgccgcccagagagagctgatcaagaccaccgtgatcaaccccatcgccgagagcaacggcatcagatgggacaacggcgccgagatctacctggccttcttccccggcaccgagatgttcctggagaccttcaacttctaccccctgaccatcggcatctacagagtgaagcacggcatgatggacccccagtacctgaagaaggccctgagacagagatacggcagcctgaccgccgacaagtggatgagccagaagaccgtggccatcgccaagagcctgaaggacgtggagcagctgaagtggggcagaggcggcctgagcgacaccgccagagtgttcctgcagaagttcggcatcaagctgccctga

SEQ ID NO: 5431 - RNA, 708 nt, synthetic construct
  misc_feature 1..708: note = derived and/or modified CDS sequence (opt4) from MELV(TRVL 9375)__KX817329.1__N
  source 1..708: mol_type = other RNA
atgggcgacctgatcttctacgacgtggccagcaccggcgccaacggcttcgaccccgacgccggctacctggccttcaccatcgcccacggcgaggccatcaacctgagcgccgtgagaatcttcttcctgaacgccgccaaggccaaggccgccctgagcagaaagcccgagagaaaggccacccccaagttcggcgactggcaggtggagatcgtgaacaaccacttccccggcaacagaaacaaccccatcggcaacaacgacctgaccatccacagactgagcggctacctggccagatgggtgctggacctgttcaaggagaacgaggacgagagccagaaggagctgatccagagcaccatcatcaaccccatcgccgagagcaacggcatccactgggccaacggcgtggagatctacctgagcttcttccccggcaccgagatgttcctggaggccttcagattctaccccctgaccatcggcatctacagagtgaagcacggcctgatggacccccagtacctgaagaaggccctgagacagagatacggcaccctgaccgccgacaagtggatggcccagaagaccaccatgatcgccaagagcctgaaggacgtggagcagctgaagtggggcaagggcggcctgagcgacgccgccagaaccttcctgcagaagttcggcgtgagactgccctga

SEQ ID NO: 5432 - RNA, 708 nt, synthetic construct
  misc_feature 1..708: note = derived and/or modified CDS sequence (opt4) from MBV__U31989.1__N
  source 1..708: mol_type = other RNA
atgagcgacctggtgttctacgacgtggccagcaccggcgccaacggcttcgaccccgacgccggctacgtggacttctgcgccaagcacggcgagagcatcaacctggccgccgtgagaatcttcttcctgaacgccgccaaggccaaggccgccctgagcagaaagcccgagagaaaggccaaccccaagttcggcgagtggcaggtggagatcgtgaacaaccacttccccgccaacagaaacaaccccatcggcaacaacgacctgaccatccacagaatcagcggctacctggccagatgggtgctggagcagtacagagagaacgaggacgagagccagagagagctggtgaagaccaccgtgatcaaccccatcgccgagagcaacggcatcagatgggagaacggccccgagatctacctggccttcttccccggcaccgagatgttcctggagaccttcaagttctaccccctgaccatcggcatctacagagtgaagcacggcatgatggacccccagtacctgaagaaggccctgagacagagatacggcagcctgaccgccgagaagtggatgagccagaagaccggcatgatcgccaagagcctgaaggaggtggagcagctgaagtggggcagaggcggcctgagcgacaccgccagaaccttcctgcagaagttcggcatcagactgccctga

SEQ ID NO: 5433 - RNA, 708 nt, synthetic construct
  misc_feature 1..708: note = derived and/or modified CDS sequence (opt4) from SAV(VR723)__U47139.1__N
  source 1..708: mol_type = other RNA
atgagcgagctggtgttctacgacgtggccagcaccggcgccaacggcttcgaccccgacgccggctacctggccttctgcgtgaagcacggcgagagcatcagcctgagcagcgtgagaatcttcttcctgaacgccgccaaggccaaggccgccctgagcagaaagcccgagagaaaggccaaccccaagttcggcgagtggcaggtggagatcgtgaacaaccacttccccggcaacagaaacaaccccatcgacaacctggacctgaccatccacagactgagcggctacctggccagatgggtgctggagcagttcatcgagaacgaggacgagagccagagagagctgatcaagaccaccgtgatcaaccccatcgccgagagcaacggcatcaagtgggagaacggcgccgagatctacctgagcttcttccccggcaccgagatgttcctggagatcttcaagttctaccccctgaccatcggcatctacagagtgaagcagggcatgatggacccccagtacctgaagaaggccctgagacagagatacggcagcctgaccgccgacaagtggatgagccagaaggtgggcgccatcgccaagagcctgaaggacatcgagcagctgaagtggggcaagggcggcctgagcgacaccgccagaaccttcctgcagaagttcggcatcaagctgccctga

SEQ ID NO: 5434 - RNA, 708 nt, synthetic construct
  misc_feature 1..708: note = derived and/or modified CDS sequence (opt4) from SDNV(BeAr 103645)__U47140.1__N
  source 1..708: mol_type = other RNA
atgggcgacctggtgttctacgacgtggccagcaccggcgccaacggcttcgaccccgacgccggcttcgtggccttcatggccggccacggcgagagcatcaacctgaccgccgtgagaatcttcttcctgaacgccgccaaggccaaggccgccctgagcagaaagcccgagagaaaggccacccccaagttcggcgactggcaggtggagatcgtgaacaaccacttccccggcaacagaaacaaccccatcggcaacaacgacctgaccatccacagaatcagcggctacctggccagatggaccctggagcacttcagagagggcggcgacgaggcccagaaggagctgatcagaaccaccatcatcaaccccatcgccgagagcaacggcatccactgggccaacggcgccgagatctacctgagcttcttccccggcaccgagatgttcctggaggccttcaagttctaccccctgaccatcggcatctacagagtgaagcacggcatgatggacgcccagtacctgaagaaggccctgagacagagatacggcaccctgaccgccgacgagtggatggcccagaagaccgtgctgatcaccaagagcctgaaggacgtggagcagctgaagtggggcagaggcggcctgagcgacgccgccagaaccttcctgagcaagttcggcgtgaagctgccctga

SEQ ID NO: 5435 - RNA, 708 nt, synthetic construct
  misc_feature 1..708: note = derived and/or modified CDS sequence (opt4) from SDNV(BeAr 103645)__KX817335.1__N
  source 1..708: mol_type = other RNA
atgggcgacctggtgttctacgacgtggccagcaccggcgccaacggcttcgaccccgacgccggcttcgtggccttcatggccggccacggcgagagcatcaacctgaccgccgtgagaatcttcttcctgaacgccgccaaggccaaggccgccctgagcagaaagcccgagagaaaggccacccccaagttcggcgactggcaggtggagatcgtgaacaaccacttccccggcaacagaaacaaccccatcggcaacaacgacctgaccatccacagaatcagcggctacctggccagatggaccctggagcacttcagagagggcgaggacgaggcccagaaggagctgatcagaaccaccatcatcaaccccatcgccgagagcaacggcatccactgggccaacggcgccgagatctacctgagcttcttccccggcaccgagatgttcctggaggccttcaagttctaccccctgaccatcggcatctacagagtgaagcacggcatgatggacgcccagtacctgaagaaggccctgagacagagatacggcaccctgaccgccgacaagtggatggcccagaagaccgtgctgatcaccaagagcctgaaggacgtggagcagctgaagtggggcagaggcggcctgagcgacgccgccagaaccttcctgagcaagttcggcgtgaagctgccctga

SEQ ID NO: 5436 - RNA, 708 nt, synthetic construct
  misc_feature 1..708: note = derived and/or modified CDS sequence (opt4) from SSHV__EU294510.1__N
  source 1..708: mol_type = other RNA
atgagcgacctggtgttctacgacgtggccagcaccggcgccaacggcttcgaccccgacgccggctacatggccttctgcgtgaagtacgccgagagcgtgaacctggccgccgtgagaatcttcttcctgaacgccgccaaggccaaggccgccctgagcagaaagcccgagagaaaggccaaccccaagttcggcgagtggcaggtggaggtggtgaacaaccacttccccggcaacagaaacaaccccatcaacagcgacgacctgaccatccacagactgagcggctacctggccagatgggtgctggagcagtacaaggagaacgaggacgagagcagaagagagctgatcaagaccaccatcatcaaccccatcgccgagagcaacggcgtgagatgggacagcggcgccgagatctacctgagcttcttccccggcaccgagatgttcctggagaccttcaagttctaccccctgaccatcggcatctacagagtgaagcagggcatgatggacccccagtacctgaagaaggccctgagacagagatacggcagcctgaccgccgacaagtggatgagccagaaggtgaccgccatcgccaagagcctgaaggaggtggagcagctgaagtggggcagaggcggcctgagcgacaccgccagaagcttcctgcagaagttcggcatcagactgccctga

SEQ ID NO: 5437 - RNA, 708 nt, synthetic construct
  misc_feature 1..708: note = derived and/or modified CDS sequence (opt4) from SSHV(F10838)__KM215563.1__N
  source 1..708: mol_type = other RNA
atgagcgacctggtgttctacgacgtggccagcaccggcgccaacggcttcgaccccgacgccggctacatggccttctgcgtgaagtacgccgagagcgtgaacctggccgccgtgagaatcttcttcctgaacgccgccaaggccaaggccgccctgagcagaaagcccgagagaaaggccaaccccaagttcggcgagtggcaggtggaggtggtgaacaaccacttccccggcaacagaaacaaccccatcaacagcgacgacctgaccatccacagactgagcggctacctggccagatgggtgctggagcagtacaaggagaacgaggacgagagcagaagagagctgatcaagaccaccatcatcaaccccatcgccgagagcaacggcgtgagatgggacagcggcgccgagatctacctgagcttcttccccggcaccgagatgttcctggagaccttcaagttctaccccctgaccatcggcatctacagagtgaagcagggcatgatggacccccagtacctgaagaaggccctgagacagagatacggcagcctgaccgccgacaagtggatgagccagaaggtgaccgccatcgccaagagcctgaaggaggtggagcagctgaagtggggcagaggcggcctgagcgacaccgccagaagcctgctgcagaagttcggcatcagactgccctga

SEQ ID NO: 5438 - RNA, 708 nt, synthetic construct
  misc_feature 1..708: note = derived and/or modified CDS sequence (opt4) from SORV(SORV-252)__GU018050.2__N
  source 1..708: mol_type = other RNA
atgggcgacctggtgttctacgacgtggccagcaccggcgccaacggcttcgaccccgacgccggcttcgtggccttcatggccgaccacggcgagagcatcagcctgagcgccgtgagaatcttcttcctgaacgccgccaaggccaaggccgccctggccagaaagcccgagagaaaggccaaccccaagttcggcgagtggcaggtggagatcgtgaacaaccacttccccggcaacagaaacaaccccatcggcaacaacgacctgaccatccacagactgagcggctacctggccagatgggtgctggagcacttcaccgaggacgaggacgagagccagagagagctgatcagaagcaccatcatcaaccccatcgccgagagcaacggcatcagatggaacaacggccccgagatctacctgagcttcttccccggcaccgagatgttcctggaggccttcaagttctaccccctgaccatcggcatctacagagtgaagcacggcctgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5439 - RNA, 708 nt, synthetic construct
  misc_feature 1..708: note = derived and/or modified CDS sequence (opt4) from SORV(NJO 94F)__U47141.1__N
  source 1..708: mol_type = other RNA
atgggcgacctggtgttctacgacgtggccagcaccggcgccaacggcttcgaccccgacgccggcttcgtggccttcatggccgaccacggcgagagcatcaacctgagcgccgtgagaatcttcttcctgaacgccgccaaggccaaggccgccctggccagaaagcccgagagaaaggccaaccccaagttcggcgagtggcaggtggagatcgtgaacaaccacttccccggcaacagaaacaaccccatcggcaacaacgacctgaccatccacagactgagcggctacctggccagatgggtgctggagcacttcaccgaggacgaggacgagagccagagagagctgatcagaagcaccatcatcaaccccatcgccgagagcaacggcatccactggaacaacggccccgagatctacctgagcttcttccccggcaccgagatgttcctggaggccttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5440 - RNA, 708 nt, synthetic construct
  misc_feature 1..708: note = derived and/or modified CDS sequence (opt4) from SORV(NJO-94F)__KX817338.1__N
  source 1..708: mol_type = other RNA
atgggcgacctggtgttctacgacgtggccagcaccggcgccaacggcttcgaccccgacgccggcttcgtggccttcatggccgaccacggcgagagcatcaacctgagcgccgtgagaatcttcttcctgaacgccgccaaggccaaggccgccctggccagaaagcccgagagaaaggccaaccccaagttcggcgagtggcaggtggagatcgtgaacaaccacttccccggcaacagaaacaaccccatcggcaacaacgacctgaccatccacagactgagcggctacctggccagatgggtgctggagcacttcaccgaggacgaggacgagagccagagagagctgatcagaagcaccatcatcaaccccatcgccgagagcaacggcatccactggaacaacggccccgagatctacctgagcttcttccccggcaccgagatgttcctggaggccttcaagttctaccccctgaccatcggcatctacagagtgaagcacggcctgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5441 - RNA, 708 nt, synthetic construct
  misc_feature 1..708: note = derived and/or modified CDS sequence (opt4) from TAHV__Z68497.1__N
  source 1..708: mol_type = other RNA
atgagcgacctggtgttctacgacgtggccagcaccggcgccaacggcttcgaccccgacgccggctacgtggacttctgcatcaagcacggcgaggccatcaacctgcacagcgtgagaatcttcttcctgaacgccgccaaggccaaggccgccctggccagaaagcccgagagaaaggccagccccaagttcggcgagtggcaggtggaggtggtgaactaccacttccccggcaacagaaacaaccccatcgacaacaacgacctgaccatccacagactgtacggctacctggccagatgggtgctggagcagttcaaggagaacgaggacgccgcccagagagagctgatcaagaccaccgtgatcaaccccatcgccgagagcaacggcatcagatgggacaacggcgccgagatctacctggccttcttccccggcaccgagatgttcctggagaccttcaacttctaccccctgaccatcggcatctacagagtgaagcagggcatgatggacccccagtacctgaagaaggccctgagacagagatacggcagcctgaccgccgacaagtggatgagccagaagaccaccgccatcgccaagagcctgaaggacgtggagcagctgaagtggggcagaggcggcctgagcgacaccgccagaaccttcctgcagaagttcggcatcagactgccctga

SEQ ID NO: 5442 - RNA, 708 nt, synthetic construct
  misc_feature 1..708: note = derived and/or modified CDS sequence (opt4) from TAHV(22595-6)__HM036217.1__N
  source 1..708: mol_type = other RNA
atgagcgacctggtgttctacgacgtggccagcaccggcgccaacggcttcgaccccgacgccggctacgtggacttctgcatcaagcacggcgaggccatcaacctgcacagcgtgagaatcttcttcctgaacgccgccaaggccaaggccgccctggccagaaagcccgagagaaaggccagccccaagttcggcgagtggcaggtggaggtggtgaacaaccacttccccggcaacagaaacaaccccatcgacaacaacgacctgaccatccacagactgagcggctacctggccagatgggtgctggagcagttcaaggagaacgaggacgccgcccagagagagctgatcaagaccaccgtgatcaaccccatcgccgagagcaacggcatcagatgggacaacggcgccgagatctacctggccttcttccccggcaccgagatgttcctggagaccttcaacttctaccccctgaccatcggcatctacagagtgaagcagggcatgatggacccccagtacctgaagaaggccctgagacagagatacggcagcctgaccgccgacaagtggatgagccagaagaccaccgccatcgccaagagcctgaaggacgtggagcagctgaagtggggcagaggcggcctgagcgacaccgccagaaccttcctgcagaagttcggcatcagactgccctga

SEQ ID NO: 5443 - RNA, 708 nt, synthetic construct
  misc_feature 1..708: note = derived and/or modified CDS sequence (opt4) from TAHV(NM08003)__HQ541823.1__N
  source 1..708: mol_type = other RNA
atgagcgacctggtgttctacgacgtggccagcaccggcgccaacggcttcgaccccgacgccggctacgtggacttctgcatcaagcacggcgaggccatcaacctgcacagcgtgagaatcttcttcctgaacgccgccaaggccaaggccgccctggccagaaagcccgagagaaaggccagccccaagttcggcgagtggcaggtggaggtggtgaacaaccacttccccggcaacagaaacaaccccatcgacaacaacgacctgaccatccacagactgagcggctacctggccagatgggtgctggagcagttcaaggagaacgacgacgccgcccagagagagctgatcaagaccaccgtgatcaaccccatcgccgagagcaacggcatcagatgggacaacggcgccgagatctacctggccttcttccccggcaccgagatgttcctggagaccttcaacttctaccccctgaccatcggcatctacagagtgaagcagggcatgatggacccccagtacctgaagaaggccctgagacagagatacggcagcctgaccgccgacaagtggatgagccagaagaccaccgccatcgccaagagcctgaaggacgtggagcagctgaagtggggcagaggcggcctgagcgacaccgccagaaccttcctgcagaagttcggcatcagactgccctga

SEQ ID NO: 5444 - RNA, 708 nt, synthetic construct
  misc_feature 1..708: note = derived and/or modified CDS sequence (opt4) from TAHV(XJ0625)__EU622820.2__N
  source 1..708: mol_type = other RNA
atgagcgacctggtgttctacgacgtggccagcaccggcgccaacggcttcgaccccgacgccggctacgtggacttctgcgtgaagtacggcgaggccatcaacctgcacagcgtgagaatcttcttcctgaacgccgccaaggccaaggccgccctggccagaaagcccgagagaaaggccagccccaagttcggcgagtggcaggtggaggtggtgaacaaccacttccccggcaacagaaacaaccccatcgacaacaacgacctgaccatccacagactgagcggctacctggccagatgggtgctggagcagttcaaggagaacgaggacgccgcccagagagagctgatcaagaccaccgtgatcaaccccatcgccgagagcaacggcatcagatgggacaacggcgccgagatctacctggccttcttccccggcaccgagatgttcctggagaccttcaacttctaccccctgaccatcggcatctacagagtgaagcagggcatgatggacccccagtacctgaagaaggccctgagacagagatacggccccctgaccgccgacaagtggatgagccagaagaccgtggccatcgccaagagcctgaaggacgtggagcagctgaagtggggcagaggcggcctgagcgacaccgccagaaccttcctgcagaagttcggcatcagactgccctga

SEQ ID NO: 5445 - RNA, 708 nt, synthetic construct
  misc_feature 1..708: note = derived and/or modified CDS sequence (opt4) from TAHV(XJ0708)__HM243139.1__N
  source 1..708: mol_type = other RNA
atgagcgacctggtgttctacgacgtggccagcaccggcgccaacggcttcgaccccgacgccggctacgtggacttctgcgccaagtacggcgaggccatcaacctgcacagcgtgagaatcttcttcctgaacgccgccaaggccaaggccgccctggccagaaagcccgagagaaaggccagccccaagttcggcgagtggcaggtggaggtggtgaacaaccacttccccggcaacagaaacaaccccatcgacaacaacgacctgaccatccacagactgagcggctacctggccagatgggtgctggagcagttcaaggagaacgaggacgccgcccagagagagctgatcaagaccaccgtgatcaaccccatcgccgagagcaacggcatcagatgggacaacggcgccgagatctacctggccttcttccccggcaccgagatgttcctggagaccttcaacttctaccccctgaccatcggcatctacagagtgaagcagggcatgatggacccccagtacctgaagaaggccctgagacagagatacggccccctgaccgccgacaagtggatgagccagaagaccgtggccatcgccaagagcctgaaggacgtggagcagctgaagtggggcagaggcggcctgagcgacaccgccagaaccttcctgcagaagttcggcatcagactgccctga

SEQ ID NO: 5446 - RNA, 708 nt, synthetic construct
  misc_feature 1..708: note = derived and/or modified CDS sequence (opt4) from TVTV(AR42)__KX891323.1__N
  source 1..708: mol_type = other RNA
atgagcgagctggtgttctacgacgcccccagcaccggcgccaacggcttcgaccccgacgccggctacgtggccttcatcgccgcccacgccggcagctacgacctgagcgccgtgagaatcttcttcctgaacgccgccaaggccaagaacgccctgagcagaaagcccgagggcaaggtgagcatcaagttcggcgagtggagcgtggaggtggtgaacaaccacttccccggcaacagaaacaaccccatcggcaacaacgacctgaccatccacagaatcagcggctacctggccagatgggtgctggaggagttcaagggccaggacgacgaggcccagaaggacatcatcagaagcaccatcgtgaaccccatcgccgagagcaacggcatccactgggacagcggcgccgacgcctacctgagcttcttccccggcaccgagatgttcctggagagcttcgacttcctgcccctggccatcggcatctacagagtgaagaacggcatgatggacgtgcagtacctgaagaaggccctgagacagagatacggcaccatgaccgccgacaagtggatgagcaccaagaccaccgtgatcgccaagaccctgaagagagtggagagcttcaagtggggcaagggcggcctgagcgaggccgccagagccttcctgagcaagttcaacgtgaagatcccctga

SEQ ID NO: 5447 - RNA, 708 nt, synthetic construct
  misc_feature 1..708: note = derived and/or modified CDS sequence (opt4) from TVTV(ND3374)__KM215564.1__N
  source 1..708: mol_type = other RNA
atgagcgagctggtgttctacgacgcccccagcaccggcgccaacggcttcgaccccgacgccggctacgtggccttcatcgccgcccacgccggcagctacgacctgagcgccgtgagaatcttcttcctgaacgccgccaaggccaagaacgccctgagcagaagacccgagggcaaggtgagcatcaagttcggcgagtggagcgtggaggtggtgaacaaccacttccccggcaacagaaacaaccccatcggcaacaacgacctgaccatccacagaatcagcggctacctggccagatgggtgctggaggagttcaagggccaggacgacgaggcccagaaggacatcatcagaagcaccatcgtgaaccccatcgccgagagcaacggcatccactgggacagcggcgccgacgcctacctgagcttcttccccggcaccgagatgttcctggagagcttcgacttcctgcccctggccatcggcatctacagagtgaagaacggcatgatggacgtgcagtacctgaagaaggccctgagacagagatacggcaccatgaccgccgacaagtggatgagcaccaagaccaccgtgatcgccaagaccctgaagagagtggagagcttcaagtggggcaagggcggcctgagcgaggccgccagagccttcctgagcaagttcaacgtgaagatcccctga

SEQ ID NO: 5448 - RNA, 708 nt, synthetic construct
  misc_feature 1..708: note = derived and/or modified CDS sequence (opt4) from JCV(3324-04)__HM007356.1__N
  source 1..708: mol_type = other RNA
atgggcgacctggtgttctacgacgtggccagcaccggcgccaacggcttcgaccccgacgccggcttcgtggccttcatggccgaccacggcgagagcgtgagcctgagcgccgtgagaatcttcttcctgaacgccgccaaggccaaggccgccctggccagaaagcccgagagaaaggccacccccaagttcggcgagtggcaggtggagatcgtgaacaaccacttccccggcaacagaaacaaccccatcggcaacaacgacctgaccatccacagactgagcggctacctggccagatgggtgctggagcacttcaccaccgacgacgacgagagccagagagagctgatcagaagcaccatcatcaaccccatcgccgagagcaacggcatccactggaacaacggccccgagatctacctgagcttcttccccggcaccgagatgttcctggagatcttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5449 - RNA, 708 nt, synthetic construct
  misc_feature 1..708: note = derived and/or modified CDS sequence (opt4) from JCV(61v2235)__U12796.1__N
  source 1..708: mol_type = other RNA
atgggcgacctggtgttctacgacgtggccagcaccggcgccaacggcttcgaccccgacgccggcttcgtggccttcatggccgaccacggcgagagcatcaacctgagcgccgtgagaatcttcttcctgaacgccgccaaggccaaggccgccctggccagaaagcccgagagaaaggccacccccaagttcggcgagtggcaggtggagatcgtgaacaaccacttcagcggcaacagaaacaaccccatcggcaacaacgacctgaccatccacagactgagcggctacctggccagatgggtgctggagcacttcaacagcgacgacgacgagagccagagagagctgatcagaagcaccatcatcaaccccatcgccgagagcaacggcatccactggaacaacggccccgagatctacctgagcttcttccccggcaccgagatgttcctggagatcttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5450 - RNA, 708 nt, synthetic construct
  misc_feature 1..708: note = derived and/or modified CDS sequence (opt4) from JCV(1064-03)__EF681816.1__N
  source 1..708: mol_type = other RNA
atgggcgacctggtgttctacgacgtggccagcaccggcgccaacggcttcgaccccgacgccggcttcgtggccttcatggccgaccacggcgaggccatcaacctggccgccgtgagaatcttcttcctgaacgccgccaaggccaaggccgccctggccagaaagcccgagagaaaggccacccccaagttcggcgagtggcaggtggagatcgtgaacaaccacttccccggcaacagaaacaaccccatcggcaacaacgacctgaccatccacagactgagcggctacctggccagatgggtgctggagcacttcaccgaggacgacgacgagagccagagagagctgatcagaagcaccatcatcaaccccatcgccgagagcaacggcatccactggaacaacggccccgagatctacctgagcttcttccccggcaccgagatgttcctggaggtgttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5451 - RNA, 708 nt, synthetic construct
  misc_feature 1..708: note = derived and/or modified CDS sequence (opt4) from JCV(33909)__EF681853.1__N
  source 1..708: mol_type = other RNA
atgggcgacctggtgttctacgacgtggccagcaccggcgccaacggcttcgaccccgacgccggcttcgtggccttcatggccgaccacggcgaggtgatcaacctggccgccgtgagaatcttcttcctgaacgccgccaaggccaaggccgccctggccagaaagcccgagagaaaggccacccccaagttcggcgagtggcaggtggagatcgtgaacaaccacttccccggcaacagaaacaaccccatcggcaacaacgacctgaccatccacagactgagcggctacctggccagatgggtgctggagcacttcaccgaggacgacgacgagagccagagagagctgatcagaagcaccatcatcaaccccatcgccgagagcaacggcatccactggaacaacggccccgagatctacctgagcttcttccccggcaccgagatgttcctggaggtgttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5452 - RNA, 708 nt, synthetic construct
  misc_feature 1..708: note = derived and/or modified CDS sequence (opt4) from JCV(2179-00)__EF681808.1__N
  source 1..708: mol_type = other RNA
atgggcgacctggtgttctacgacgtggccagcaccggcgccaacggcttcgaccccgacgccggcttcgtggccttcatggccgaccacggcgagagcgtgagcctgagcgccgtgagaatcttcttcctgaacgccgccaaggccaaggccgccctggccagaaagcccgagagaaaggccacccccaagttcggcgagtggcaggtggagatcgtgaacaaccacttccccggcaacagaaacaaccccatcggcaacaacgacctgaccatccacagactgagcggctacctggccagatgggtgctggagcacttcaccaccgacgacgacgagagccagagagagctgatcagaagcaccatcatcaaccccatcgccgagagcaacggcatccactggaacaacggccccgagatctacctgagcttcttccccggcaccgagatgttcctggagatcttcaagttctaccccctgaccatcggcatctacagagtgaagcacggcatgatggacccccagtacctgaagaaggccctgagacagagatacggcatcctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5453 - RNA, 708 nt, synthetic construct
  misc_feature 1..708: note = derived and/or modified CDS sequence (opt4) from JCV(2989-06)__EF681849.1__N
  source 1..708: mol_type = other RNA
atgggcgacctgatcttctacgacgtggccagcaccggcgccaacggcttcgaccccgacgccggcttcgtggccttcatggccgaccacggcgagagcgtgagcctgagcgccgtgagaatcttcttcctgaacgccgccaaggccaaggccgccctggccagaaagcccgagagaaaggccacccccaagttcggcgagtggcaggtggagatcgtgaacaaccacttccccggcaacagaaacaaccccatcggcaacaacgacctgaccatccacagactgagcggctacctggccagatgggtgctggagcacttcaccaccgacgacgacgagagccagagagagctgatcagaagcaccatcatcaaccccatcgccgagagcaacggcatccactggaacaacggccccgagatctacctgagcttcttccccggcaccgagatgttcctggagatcttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5454 - RNA, 708 nt, synthetic construct
  misc_feature 1..708: note = derived and/or modified CDS sequence (opt4) from JCV(5592-02)__EF681804.1__N
  source 1..708: mol_type = other RNA
atgggcgacctggtgttctacgacgtggccagcaccggcgccaacggcttcgaccccgacgccggcttcgtggccttcatggccgaccacggcgagagcgtgagcctgagcgccgtgagaatcttcttcctgaacgccgccaaggccaaggccgccctggccagaaagcccgagagaaaggccacccccaagttcggcgagtggcaggtggagatcgtgaacaaccacttccccggcaacagaaacagccccatcggcaacaacgacctgaccatccacagactgagcggctacctggccagatgggtgctggagcacttcaccaccgacgacgacgagagccagagagagctgatcagaagcaccatcatcaaccccatcgccgagagcaacggcatccactggaacaacggccccgagatctacctgagcttcttccccggcaccgagatgttcctggagatcttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5455 - RNA, 708 nt, synthetic construct
  misc_feature 1..708: note = derived and/or modified CDS sequence (opt4) from JCV(F5609)__KM215546.1__N
  source 1..708: mol_type = other RNA
atgggcgacctggtgttctacgacgtggccagcaccggcgccaacggcttcgaccccgacgccggcttcgtggccttcatggccgaccacggcgagagcgtgagcctgagcgccgtgagaatcttcttcctgaacgccgccaaggccaaggccgccctggccagaaagcccgagagaaaggccacccccaagttcggcgagtggcaggtggagatcgtgaacaaccacttccccggcaacagaaacaaccccatcggcaacaacgacctgaccatccacagactgagcggctacctggccagatgggtgctggagcacttcaccaccgacgacgacgagagccagagagagctgatcagaagcaccatcatcaaccccatcgccgagagcaacggcatccactggaacaacggccccgagatctacctgagcttcttccccggcaccgagatgttcctggagatcttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgaccaagttcggcgtgaagctgccctga

SEQ ID NO: 5456 - RNA, 708 nt, synthetic construct
  misc_feature 1..708: note = derived and/or modified CDS sequence (opt4) from JCV(F6577)__KM215557.1__N
  source 1..708: mol_type = other RNA
atgggcgacctggtgttctacgacgtggccagcaccggcgccaacggcttcgaccccgacgccggcttcgtggccttcatggccgaccacggcgagagcgtgagcctgagcgccgtgagaatcttcttcctgaacgccgccaaggccaaggccgccctgagcagaaagcccgagagaaaggccacccccaagttcggcgagtggcaggtggagatcgtgaacaaccacttccccggcaacagaaacaaccccatcggcaacaacgacctgaccatccacagactgagcggctacctggccagatgggtgctggagcacttcaccaccgacgacgacgagagccagagagagctgatcagaagcaccatcatcaaccccatcgccgagagcaacggcatccactggaacaacggccccgagatctacctgagcttcttccccggcaccgagatgttcctggagatcttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5457 - RNA, 708 nt, synthetic construct
  misc_feature 1..708: note = derived and/or modified CDS sequence (opt4) from JCV(W13135)__KM215552.1__N
  source 1..708: mol_type = other RNA
atgggcgacctggtgttctacgacgtggccagcaccggcgccaacggcttcgaccccgacgccggcttcgtggccttcatggccgaccacggcgagagcgtgaacctgagcgccgtgagaatcttcttcctgaacgccgccaaggccaaggccgccctggccagaaagcccgagagaaaggccacccccaagttcggcgagtggcaggtggagatcgtgaacaaccacttccccggcaacagaaacaaccccatcggcaacaacgacctgaccatccacagactgagcggctacctggccagatgggtgctggagcacttcaccaccgacgacgacgagagccagagagagctgatcagaagcaccatcatcaaccccatcgccgagagcaacggcatccactggaacaacggccccgagatctacctgagcttcttccccggcaccgagatgttcctggagatcttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5458 - RNA, 708 nt, synthetic construct
  misc_feature 1..708: note = derived and/or modified CDS sequence (opt4) from JCV(W18393)__KM215559.1__N
  source 1..708: mol_type = other RNA
atgggcgacctggtgttctacgacgtggccagcaccggcgccaacggcttcgaccccgacgccggcttcgtggccttcatggccgaccacggcgagagcatcaacctgagcgccgtgagaatcttcttcctgaacgccgccaaggccaaggccgccctggccagaaagcccgagagaaaggccacccccaagttcggcgagtggcaggtggagatcatcaacaaccacttccccggcaacagaaacaaccccatcggcaacaacgacctgaccatccacagactgagcggctacctggccagatgggtgctggagcacttcaccgccgacgacgacgagagccagagagagctgatcagaagcaccatcatcaaccccatcgccgagagcaacggcatccactggaacaacggccccgagatctacctgagcttcttccccggcaccgagatgttcctggagatcttcaagttctaccccctgaccatcggcatctacagagtgaagcacggcatgatggacccccagtacctgaagaaggccctgagacagagatacggcaccctgaccgccgagaagtggatggcccagaagaccgtgctgatcgccaagagcctgaaggacgtggagcagctgaagtggggcagaggcggcctgagcgacgccgccagaaccttcctgatcaagttcggcgtgaagctgccctga

SEQ ID NO: 5459 - RNA, 708 nt, synthetic construct
  misc_feature 1..708: note = derived and/or modified CDS sequence (opt4) from KEYV(KEYV/Ochlerotatus atlanticus/USA/KEYVLK01/2005)__KT630290.1__N
  source 1..708: mol_type = other RNA
atgggcgacctggtgttctacgacgtggccagcaccggcgccaacggcttcgaccccgacgccggctacgtggccttcatggccaaccacggcgagagcatcagcctgagcaccgtgagaatcttcttcctgaacgccgccaaggccaaggccgccctgaccagaaagcccgagagaaaggccacccccaagttcggcgagtggcaggtggagatcgtgaacaaccacttccccggcaacagaaacaaccccatcggcaacaacgacctgaccctgcacagaatcagcggctacctggccagatgggtgctggagcacttcggcgagggcgaggacgagagccagaaggagctgatcaagagcaccgtgatcaaccccatcgccgagagcaacggcatcagatggggcaacggcgtggagatctacctgagcttcttccccggcaccgagatgttcctggagctgttcaagttctaccccctgaccatcggcatctacagagtgaagcacggcatgatggacgcccagtacctgaagaaggccctgagacagagatacggcaccctgaccgccgacaagtggatggcccagaagaccagcatgatcaccaagagcctgaaggacgtggagcagctgaagtggggcaagggcggcctgagcgacaccgccagagccttcctggccaagttcggcgtgagactgccctga

SEQ ID NO: 5460 - RNA, 708 nt, synthetic construct
  misc_feature 1..708: note = derived and/or modified CDS sequence (opt4) from KEYV(KEYV/Ochlerotatus atlanticus/USA/KEYVLK02/2005)__KT630293.1__N
  source 1..708: mol_type = other RNA
atgggcgacctggtgttctacgacgtggccagcaccggcgccaacggcttcgaccccgacgccggctacgtggccttcatggccaaccacggcgagagcatcagcctgagcaccgtgagaatcttcttcctgaacgccgccaaggccaaggccgccctgaccagaaagagcgagagaaaggccacccccaagttcggcgagtggcaggtggagatcgtgaacaaccacttccccggcaacagaaacaaccccatcggcaacaacgacctgaccctgcacagaatcagcggctacctggccagatgggtgctggagcacttcggcgagggcgaggacgagagccagaaggagctgatcaagagcaccgtgatcaaccccatcgccgagagcaacggcatcagatggggcaacggcgtggagatctacctgagcttcttccccggcaccgagatgttcctggagctgttcaagttctaccccctgaccatcggcatctacagagtgaagcacggcatgatggacgcccagtacctgaagaaggccctgagacagagatacggcaccctgaccgccgacaagtggatggcccagaagaccagcatgatcaccaagagcctgaaggacgtggagcagctgaagtggggcaagggcggcctgagcgacaccgccagagccttcctggccaagttcggcgtgagactgccctga

SEQ ID NO: 5461 - RNA, 708 nt, synthetic construct; identical to SEQ ID NO: 5459
  misc_feature 1..708: note = derived and/or modified CDS sequence (opt4) from KEYV(C14031-33)__U12801.1__N
  source 1..708: mol_type = other RNA

SEQ ID NO: 5462 - RNA, 708 nt, synthetic construct
  misc_feature 1..708: note = derived and/or modified CDS sequence (opt4) from LACV(Human/78)__NC_004110.1__N
  source 1..708: mol_type = other RNA
atgagcgacctggtgttctacgacgtggccagcaccggcgccaacggcttcgaccccgacgccggctacatggacttctgcgtgaagaacgccgagctgctgaacctggccgccgtgagaatcttcttcctgaacgccgccaaggccaaggccgccctgagcagaaagcccgagagaaaggccaaccccaagttcggcgagtggcaggtggaggtgatcaacaaccacttccccggcaacagaaacaaccccatcggcaacaacgacctgaccatccacagactgagcggctacctggccagatgggtgctggaccagtacaacgagaacgacgacgagagccagcacgagctgatcagaaccaccatcatcaaccccatcgccgagagcaacggcgtgggctgggacagcggccccgagatctacctgagcttcttccccggcaccgagatgttcctggagaccttcaagttctaccccctgaccatcggcatccacagagtgaagcagggcatgatggacccccagtacctgaagaaggccctgagacagagatacggcaccctgaccgccgacaagtggatgagccagaaggtggccgccatcgccaagagcctgaaggacgtggagcagctgaagtggggcaagggcggcctgagcgacaccgccaagaccttcctgcagaagttcggcatcagactgccctga

SEQ ID NO: 5463 - RNA, 708 nt, synthetic construct
  misc_feature 1..708: note = derived and/or modified CDS sequence (opt4) from LACV__KP271107.1__N
  source 1..708: mol_type = other RNA
atgagcgacctggtgttctacgacgtggccagcaccggcgccaacggcttcgaccccgacaccggctacatggacttctgcgtgaagaacgccgagagcctgaacctggccgccgtgagaatcttcttcctgaacgccgccaaggccaaggccgccctgagcagaaagcccgagagaaaggccaaccccaagttcggcgagtggcaggtggaggtgatcaacaaccacttccccggcaacagaaacaaccccatcggcaacaacgacctgaccatccacagactgagcggctacctggccagatgggtgctggaccagtacaacgagaacgacgacgagagccagcacgagctgatcagaaccaccatcatcaaccccatcgccgagagcaacggcgtgggctgggacagcggccccgagatctacctgagcttcttccccggcaccgagatgttcctggagaccttcaagttctaccccctgaccatcggcatccacagagtgaagcagggcatgatggacccccagtacctgaagaaggccctgagacagagatacggcaccctgaccgccgacaagtggatgagccagaaggtggccgccatcgccaagagcctgaaggacgtggagcagctgaagtggggcaagggcggcctgagcgacaccgccaagaccttcctgcagaagttcggcatcagactgccctga

SEQ ID NO: 5464 - RNA, 708 nt, synthetic construct
  misc_feature 1..708: note = derived and/or modified CDS sequence (opt4) from LACV(BEN2_Lafayette_WI_2007)__GU596386.1__N
  source 1..708: mol_type = other RNA
atgagcgacctggtgttctacgacgtggccagcaccggcgccaacggcttcgaccccgacgccggctacatggacttctgcgtgaagaacgccgagagcctgaacctggccgccgtgagaatcttcttcctgaacgccgccaaggccaaggccgccctgagcagaaagcccgagagaaaggccaaccccaagttcggcgagtggcaggtggaggtgatcaacaaccacttccccggcaacagaaacaaccccatcggcaacaacgacctgaccatccacagactgagcggctacctggccagatgggtgctggaccagtacaacgagaacgacgacgagagccagcacgagctgatcagaaccaccatcatcaaccccatcgccgagagcaacggcgtgggctgggacagcggccccgagatctacctgagcttcttccccggcaccgagatgttcctggagaccttcaagttctaccccctgaccatcggcatccacagagtgaagcagggcatgatggacccccagtacctgaagaaggccctgagacagagatacggcaccctgaccgccgacaagtggatgagccagaaggtggccgccatcgccaagagcctgaaggacgtggagcagctgaagtggggcaagggcggcctgagcgacaccgccaagaccttcctgcagaagttcggcatcagactgccctga

SEQ ID NO: 5465 - RNA, 708 nt, synthetic construct
  misc_feature 1..708: note = derived and/or modified CDS sequence (opt4) from LACV(Dallas/TX/2009)__GU591164.1__N
  source 1..708: mol_type = other RNA
atgagcgacctggtgttctacgacgtggccagcaccggcgccaacggcttcgaccccgacgccggctacatggacttctgcgtgaagaacgccgagagcctgaacctggccgccgtgagaatcttcttcctgaacgccgccaaggccaaggccgccctgagcagaaagcccgagagaaaggccaaccccaagttcggcgagtggcaggtggaggtggtgaacaaccacttccccggcaacagaaacaaccccatcggcaacaacgacctgaccatccacagactgagcggctacctggccagatgggtgctggaccagtacaacgagaacgacgacgagagccagagagagctgatcagaaccaccatcatcaaccccatcgccgagagcaacggcgtgagatgggacagcggccccgagatctacctgagcttcttccccggcaccgagatgttcctggagaccttcaagttctaccccctgaccatcggcatccacagagtgaagcagggcatgatggacccccagtacctgaagaaggccctgagacagagatacggcaccctgaccgccgacaagtggatgagccagaaggtggccgccatcgccaagagcctgaaggacgtggagcagctgaagtggggcaagggcggcctgagcgacaccgccaagaccttcctgcagaagttcggcatcagactgccctga

SEQ ID NO: 5466 - RNA, 708 nt, synthetic construct
  misc_feature 1..708: note = derived and/or modified CDS sequence (opt4) from LACV(Fort Bend County/TX/2009)__GU591167.1__N
  source 1..708: mol_type = other RNA
atgagcgacctggtgttctacgacgtggccagcaccggcgccaacggcttcgaccccgacgccggctacatggacttctgcgtgaagaacgccgagagcctgaacctggccgccgtgagaatcttcttcctgaacgccgccaaggccaaggccgccctgagcagaaagcccgagagaaaggccaaccccaagttcggcgagtggcaggtggaggtgatcaacaaccacttccccggcaacagaaacaaccccatcggcaacaacgacctgaccatccacagactgagcggctacctggccagatgggtgctggaccagtacaacgagaacgacgacgagagccagagagagctgatcagaaccaccatcatcaaccccatcgccgagagcaacggcgtgagatgggacagcggccccgagatctacctgagcttcttccccggcaccgagatgttcctggagaccttcaagttctaccccctgaccatcggcatccacagagtgaagcagggcatgatggacccccagtacctgaagaaggccctgagacagagatacggcaccctgaccgccgacaagtggatgagccagaaggtggccgccatcgccaagagcctgaaggacgtggagcagctgaagtggggcaagggcggcctgagcgacaccgccaagaccttcctgcagaagttcggcatcagactgccctga

SEQ ID NO: 5467 - RNA, 708 nt, synthetic construct
  misc_feature 1..708: note = derived and/or modified CDS sequence (opt4) from LACV(LACV/95/OH-H (CCH-MB96))__GU206135.1__N
  source 1..708: mol_type = other RNA
atgagcgacctggtgttctacgacgtggccagcaccggcgccaacggcttcgaccccgacgccggctacatggacttctgcgtgaagaacgccgagagcctgaacctggccgccgtgagaatcttcttcctgaacgccgccaaggccaaggccgccctgagcagaaagcccgagagaaaggccaaccccaagttcggcgagtggcaggtggaggtggtgaacaaccacttccccggcaacagaaacaaccccatcggcaacaacgacctgaccatccacagactgagcggctacctggccagatgggtgctggaccagtacaacgagaacgacgacgagagccagcacgagctgatcaagaccaccatcatcaaccccatcgccgagagcaacggcgtgggctgggacagcggccccgagatctacctgagcttcttccccggcaccgagatgttcctggagaccttcaagttctaccccctgaccatcggcatccacagagtgaagcagggcatgatggacccccagtacctgaagaaggccctgagacagagatacggcaccctgaccgccgacaagtggatgagccagaaggtggccgccatcgccaagagcctgaaggacgtggagcagctgaagtggggcaagggcggcctgagcgacaccgccaagaccttcctgcagaagttcggcatcagactgccctga

SEQ ID NO: 5468 - RNA, 696 nt, synthetic construct
  misc_feature 1..696: note = derived and/or modified CDS sequence (opt4) from OROV(BeAn19991)__NC_005777.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcgacatctga

SEQ ID NO: 5469 - RNA, 696 nt, synthetic construct
  misc_feature 1..696: note = derived and/or modified CDS sequence (opt4) from OROV(AR136921)__HQ830443.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5470 - RNA, 696 nt, synthetic construct
  misc_feature 1..696: note = derived and/or modified CDS sequence (opt4) from OROV(AR366927)__HQ830448.1__N
  source 1..696: mol_type = other RNA
atgagcgagttcttcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagaagtacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5471 - RNA, 696 nt, synthetic construct
  misc_feature 1..696: note = derived and/or modified CDS sequence (opt4) from OROV(BeAn 206119)__AY993909.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccgccgtggtggtgcccctggtggaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgagaccgtgggcaccttcgcctgggccagaaccggcttcagccccgccgccagagacttcctgagacagttcggcatcggcatctga

SEQ ID NO: 5472 - RNA, 696 nt, synthetic construct
  misc_feature 1..696: note = derived and/or modified CDS sequence (opt4) from OROV(BeAn 208819)__AY993911.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggtggaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5473 - RNA, 696 nt, synthetic construct
  misc_feature 1..696: note = derived and/or modified CDS sequence (opt4) from OROV(BeAn 208823)__AY993912.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggtggaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagagatggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5474 - RNA, 696 nt, synthetic construct
  misc_feature 1..696: note = derived and/or modified CDS sequence (opt4) from OROV(H244576)__HQ830444.1__N
  source 1..696: mol_type = other RNA
atgagcgagttcttcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccttccacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagaagtacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5475 - RNA, 696 nt, synthetic construct
  misc_feature 1..696: note = derived and/or modified CDS sequence (opt4) from OROV(H355186)__HQ830446.1__N
  source 1..696: mol_type = other RNA
atgagcgagttcatcttcagcgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5476 - RNA, 696 nt, synthetic construct
  misc_feature 1..696: note = derived and/or modified CDS sequence (opt4) from OROV(H356898)__HQ830447.1__N
  source 1..696: mol_type = other RNA
atgagcgagttcatcttcaacgacgtgccccagagaaccaccagcaccttcgaccccgaggccgcctacgtgagcttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5477 - RNA, 696 nt, synthetic construct
  misc_feature 1..696: note = derived and/or modified CDS sequence (opt4) from OROV(H389865)__HQ830453.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccacatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaagttcctgagacagagatacggccagaagaccgccgagcagtggatgagagaggagatcctggccgtgaaggccgccttcgagagcgtgggcaccctggcctgggccagaaccggcttcagccccgccgccagagacttcctgagacagttcgccatcggcatctga

SEQ ID NO: 5478 - RNA, 696 nt, synthetic construct
  misc_feature 1..696: note = derived and/or modified CDS sequence (opt4) from OROV(H472433)__HQ830455.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcagcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5479 - RNA, 696 nt, synthetic construct
  misc_feature 1..696: note = derived and/or modified CDS sequence (opt4) from OROV(H532490)__HQ830463.1__N
  source 1..696: mol_type = other RNA
atgagcgagttcatcttcaacgacgtgccccagagaaccaccagcaccttcgaccccgaggccgcctacgtgagcttcgaggccagatacggccaggtgctgaacgccggcgtggtgagagtgttcttcctgaaccagaagaaggccaaggacgtgctgagaaagaccagcagccccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5480 - RNA, 696 nt, synthetic construct
  misc_feature 1..696: note = derived and/or modified CDS sequence (opt4) from OROV(H543629)__HQ830467.1__N
  source 1..696: mol_type = other RNA
atgagcgagttcctgttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccggcagagacttcctgagacagttcggcatcggcatctga

SEQ ID NO: 5481 - RNA, 696 nt, synthetic construct
  misc_feature 1..696: note = derived and/or modified CDS sequence (opt4) from OROV(H543638)__HQ830468.1__N
  source 1..696: mol_type = other RNA
atgagcgagttcctgttcaacgacgtgccccagagaaccaccagcaccttcgaccccgaggccgcctacgtggccttcgaggccagatacggccaggtgctgaacgccggcgtggtgagagtgttcttcctgaaccagaagaaggccaagaacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccggcagagacttcctgagacagttcggcatcggcatctga

SEQ ID NO: 5482 - RNA, 696 nt, synthetic construct
  misc_feature 1..696: note = derived and/or modified CDS sequence (opt4) from OROV(H706890)__HQ830473.1__N
  source 1..696: mol_type = other RNA
atggccgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5483 - RNA, 696 nt, synthetic construct
  misc_feature 1..696: note = derived and/or modified CDS sequence (opt4) from OROV(H758669)__HQ830479.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatcctgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5484 - RNA, 696 nt, synthetic construct
  misc_feature 1..696: note = derived and/or modified CDS sequence (opt4) from OROV(H758687)__HQ830478.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccttcgtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5485 - RNA, 696 nt, synthetic construct
  misc_feature 1..696: note = derived and/or modified CDS sequence (opt4) from OROV(H759041)__HQ830488.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaacgacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5486 - RNA, 696 nt, synthetic construct
  misc_feature 1..696: note = derived and/or modified CDS sequence (opt4) from OROV(BeAr473358)__AF164539.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccacatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaagatcctgagacagagatacggccagaagaccgccgagcagtggatgagagaggagatcatcgccgtgaagaccgccttcgagaccgtgggcaccctggcctgggccatcaccggcttcagccccgccgccagaaacttcctgagacagttcgagatcgacatctga

SEQ ID NO: 5487 - RNA, 696 nt, synthetic construct
  misc_feature 1..696: note = derived and/or modified CDS sequence (opt4) from OROV(BeH 521086)__AY704559.1__N
  source 1..696: mol_type = other RNA
atgagcgagttcctgttcaacgacgtgccccagagaaccaccagcaccttcgaccccgaggccgcctacgtggccttcgagagcagatacggccaggtgctgaacgccggcgtggtgagagtgttcttcctgaaccagaagaaggccaaggacgtgctgagaaagaccagcagacccatggtggacctgaccttcggcggcgtgcagttcaccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagagcggcatcggcatctga

SEQ ID NO: 5488 - RNA, 696 nt, synthetic construct
  misc_feature 1..696: note = derived and/or modified CDS sequence (opt4) from OROV(BeH121923)__HM470110.1__N
  source 1..696: mol_type = other RNA
atgagcgagttcatcttcaacgacgtgccccagagaaccaccagcagcttcgaccccgaggccgcctacgtggccttcgaggccagatacggccaggtgctgaacgcctgcgtggtgagagtgttcttcctgaaccagaagaaggccaaggacgtgctgagaaagaccagctggcccatggtggacctgaccttcggcagagtgcagttcgccatggtgaacaaccacttcccccagttccagagcaaccccgtgcccgacaacggcctggccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcgacatctga

SEQ ID NO: 5489 - RNA, 696 nt, synthetic construct
  misc_feature 1..696: note = derived and/or modified CDS sequence (opt4) from OROV(BeH379693)__AF164534.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaagaaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5490 - RNA, 696 nt, synthetic construct
  misc_feature 1..696: note = derived and/or modified CDS sequence (opt4) from OROV(BeH381114)__AF164535.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatctgcatctga

SEQ ID NO: 5491 - RNA, 696 nt, synthetic construct
  misc_feature 1..696: note = derived and/or modified CDS sequence (opt4) from OROV(BeH390233)__AF164536.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgggccagttcggcatcggcatctga

SEQ ID NO: 5492 - RNA, 696 nt, synthetic construct
  misc_feature 1..696: note = derived and/or modified CDS sequence (opt4) from OROV(BeH472204)__AF164538.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacgtgcagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5493 - RNA, 696 nt, synthetic construct
  misc_feature 1..696: note = derived and/or modified CDS sequence (opt4) from OROV(BeH505442)__AF164542.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcaggccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcgacatctga

SEQ ID NO: 5494 - RNA, 696 nt, synthetic construct
  misc_feature 1..696: note = derived and/or modified CDS sequence (opt4) from OROV(BeH541863)__AF164544.1__N
  source 1..696: mol_type = other RNA
atgagcgagttcatcttcagcgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagaaacttcctgagacagttcggcatcggcatctga

SEQ ID NO: 5495 - RNA, 696 nt, synthetic construct
  misc_feature 1..696: note = derived and/or modified CDS sequence (opt4) from OROV(BeH543033)__AF164545.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagagttcctgagacagttcggcatcggcatctga

SEQ ID NO: 5496 - RNA, 696 nt, synthetic construct
  misc_feature 1..696: note = derived and/or modified CDS sequence (opt4) from OROV(BeH543618)__AF164548.1__N
  source 1..696: mol_type = other RNA
atgcaggagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5497 - RNA, 696 nt, synthetic construct
  misc_feature 1..696: note = derived and/or modified CDS sequence (opt4) from OROV(BeH544552)__AF164546.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagatcggcatcggcatctga

SEQ ID NO: 5498 - RNA, 696 nt, synthetic construct
  misc_feature 1..696: note = derived and/or modified CDS sequence (opt4) from OROV(GML444911)__AF164556.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatctacatctga

SEQ ID NO: 5499 - RNA, 696 nt, synthetic construct
  misc_feature 1..696: note = derived and/or modified CDS sequence (opt4) from OROV(IQT4083)__AF164552.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggcaagaagaccgccgagcagtggatgagagaggagatcgtggccgtgagagccgccttcgaggccgtgggcaccctggcctgggccagaaccggcttcagccccgccgccagagacttcctgagacagttcggcatcgacatctga

SEQ ID NO: 5500 - RNA, 696 nt, synthetic construct
  misc_feature 1..696: note = derived and/or modified CDS sequence (opt4) from OROV(PPS 522 H 669314)__EF467370.1__N
  source 1..696: mol_type = other RNA
atgagcgagttcatcagcaacgacgtgccccacagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatctgcatctga

SEQ ID NO: 5501 - RNA, 696 nt, synthetic construct
  misc_feature 1..696: note = derived and/or modified CDS sequence (opt4) from OROV(TVP-19254/GML-480914)__KP795083.1__N
  source 1..696: mol_type = other RNA
atgagcgagttcatcttcaacgacgtgccccagagaaccaccagcaccttcgaccccgaggccgcctacgtggccttcgaggccagatacggccaggtgctgagcgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcgacatctga

SEQ ID NO: 5502 - RNA, 696 nt, synthetic construct
  misc_feature 1..696: note = derived and/or modified CDS sequence (opt4) from OROV(TVP-19256/IQE-7894)__KP795086.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcaccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcgacatctga

SEQ ID NO: 5503 - RNA, 696 nt, synthetic construct
  misc_feature 1..696: note = derived and/or modified CDS sequence (opt4) from OROV(TVP-19258/IQT-4083)__KP795092.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagaggcaccgtggtggtgcccctggccgaggtgaagggctgcacctggaacgacggcgacgccatgtacctgggcttcgccgccggcgccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcgacatctga

SEQ ID NO: 5504 - RNA, 699 nt, synthetic construct
  misc_feature 1..699: note = derived and/or modified CDS sequence (opt4) from OROV/FPV(Aus Ch 16129)__AF362400.1__N
  source 1..699: mol_type = other RNA
atgaccgacttcgtgttcaacgacgtgccccagagagccaccagcaccttcgaccccgaggccgcctacgtggccttcgagaacagattcagagccaacctgaccgtggacgtggccagaatcttcttcctgaaccagaagaaggccaaggacagactggccaagaccgccagagccaccgtggacatcaccttcggcggcgtggtgttccccgtggtgaacaaccactaccccgagtaccagagaaaccccgtgcccgacgacggcctgaccctgcacagactgagcggctacctggccagatggctgatcgaccagtgcaacgccagccccgtgagaatgaccgagatcagaaccaaggtgatcatccccctggccgaggtgaagggctgcacctggaacgacggcgccagcatgtacctgggcttcgccgccggcgccgagatgttcctgcagagcttcaccttctaccccctggtgatcgagatgcagagagtgctgaaggacggcatggacgtgaacttcatgagaaaggtgctgagacagagatacggcaccaagaccgccgagcagtggatgagagacgacatcgtggccgtgaagaccgccttcgaggccatcaacaccatcagctgggccagaagcggcttcagccccgccgccagagagttcctgagacagttcggcatcaacatctga

SEQ ID NO: 5505 - RNA, 696 nt, synthetic construct
  misc_feature 1..696: note = derived and/or modified CDS sequence (opt4) from OROV/IQTV(IQE3728/PER/06)__KF150535.1__N
  source 1..696: mol_type = other RNA
atgagcgagttcatcttcaacgacgtgccccagagaaccaccagcaccttcgaccccgaggccgcctacgtggccttcgaggccagatacggccaggtgctgaacgccggcgtggtgagagtgttcttcctgaaccagaagaaggccaaggacgtgctgagaaagaccagcagacccatggtggacctgaccttcggcggcgtgcagttcgccatggtgaacaaccacttcccccagttccagagcaaccccgtgcccgacaacggcctgaccctgcacagactgagcggctacctggccagatgggccttcacccagatgagaagccccatcaagcaggccgagttcagagccaccgtggtggtgcccctggccgaggtgaagggctgcacctggaacgacggcgacgccatgtacctgggcttcgccgccggcaccgagatgttcctgcagaccttcaccttcttccccctggtgatcgagatgcacagagtgctgaaggacggcatggacgtgaacttcatgaagaaggtgctgagacagagatacggccagaagaccgccgagcagtggatgagagaggagatcgtggccgtgagagccgccttcgaggccgtgggcaccctggcctgggccagaaccggcttcagccccgccgccagagacttcctgagacagttcggcatcggcatctga

SEQ ID NO: 5506 - RNA, 699 nt, synthetic construct
  misc_feature 1..699: note = derived and/or modified CDS sequence (opt4) from OROV/UTIV(Be An 84785)__KF697156.1__N
  source 1..699: mol_type = other RNA
atggccgagttcgtgttcaacgacgtgccccagagaagcaccagcaccttcgaccccgaggtggcctacgccaccttcgaggccgccttcagacagaccctgaacgtgaacgtggtgagagtgttcttcctgaaccagaagaacgccaagaacgtgctgagaaagaccagcagacccaacgtggacctgaccttcggcggcgccaccttccccatcgtgaacaaccacttcccccagttccagagcaaccccgtgcccgacaacggcctgaccctgcacagactgagcggctacctggccagatggagcatggaccagatgagaaccaaccccatcagacaggccgagttcagagccgccgtggtggtgcccctggccgagatcaagggctgcacctggaacgacggcgacgccatgtacctggccttcgccgccggcgccgagatgttcctgaacaccttcaccttcttccccctggtgatcgagatgcacagagtgctgaaggacggcatggacgtgaacttcatgagaaaggtgctgagacagagatacggcaccaagaccgccgagcagtggatgaaggacgagatcatccccatcaaggccgccttcgaggccgtgggcatgctgagctgggccagaaccggcttcagccccgccgccagagacttcctgagacagttcggcatcaacgtgtga

SEQ ID NO: 5507 - RNA, 738 nt, synthetic construct
  misc_feature 1..738: note = derived and/or modified CDS sequence (opt4) from HRTV(TN)__KJ740146.1__N
  source 1..738: mol_type = other RNA
atgaccgactggagcgccatcgccgtggagatcggcaacgagcccctggacgtgcccgccctggtggagttcgccaaggagatcgcctacgagggcctggaccccgccgtgatcctgggcctgctgagagagagaggcggcgagaactggagaaacgacgtgaagtacatcatcgtgttcgccctgaccagaggcaacaagatcgtgaaggcctgcggcaagatgagcaagaagggcgccgagagaatgaccaacctggccagagtgtacgagctgaaggagaacgccgtggacagaatggccgtgacccccgtgagagtggcccagtgcctgcccacctggacctgcgccgccgccgccgccatcaaggagtacctgcccgtgggccccgccatcatgcacaacaagatccagggctaccccctggagatgatgtgcatggccttcggcagcctgatcccccaggccgacgtgagcatcgaggtgatcaaggacttcatggacgcctacagcctgtggcaggacaccttcgccagaaccatcaacgtggaccagagaaagatgaccaaggccgaggtgtacgccaagttcagagaccccctgcacgccgccgtgaacagcctgttcttccccaacgccaccagaatcagctggctgcaggccaagggcctgctgaccgccaccaaggaggccagcggcagcgtgaaggccgccgccgccgcctacagaaacatgtga

SEQ ID NO: 5508 - RNA, 738 nt, synthetic construct
  misc_feature 1..738: note = derived and/or modified CDS sequence (opt4) from HRTV(Patient1)__JX005842.1__N
  source 1..738: mol_type = other RNA
atgaccgactggagcgccatcgccgtggagatcggcaacgagcccctggacgtgcccgccctggtggagttcgccaaggagatcgcctacgagggcctggaccccgccgtgatcttcggcctgctgagagagagaggcggcgagaactggagaaacgacgtgaagtacatcatcgtgttcgccctgaccagaggcaacaagatcgtgaaggcctgcggcaagatgagcaagaagggcgccgagagaatgaccaacctggccagagtgtacgagctgaaggagaacgccgtggacagaatggccgtgacccccgtgagagtggcccagtgcctgcccacctggacctgcgccgccgccgccgccatcaaggagtacctgcccgtgggccccgccatcatgcacaacaagatccagggctaccccctggagatgatgtgcatggccttcggcagcctgatcccccaggccgacgtgagcatcgaggtgatcaaggacttcatggacgcctacagcctgtggcaggacaccttcgccagaaccatcaacgtggaccagagaaagatgaccaaggccgaggtgtacgccaagttcagagaccccctgcacgccgccgtgaacagcctgttcttccccaacgccaccagaatcagctggctgcaggccaagggcctgctgaccgccaccaaggaggccagcggcagcgtgaaggccgccgccgccgcctacagaaacatgtga

SEQ ID NO: 5509 - RNA, 738 nt, synthetic construct; identical to SEQ ID NO: 5507
  misc_feature 1..738: note = derived and/or modified CDS sequence (opt4) from HRTV(Patient2)__JX005843.1__N
  source 1..738: mol_type = other RNA

SEQ ID NO: 5510 - RNA, 732 nt, synthetic construct
  misc_feature 1..732: note = derived and/or modified CDS sequence (opt4) from PTV(PAN472868)__NC_027202.1__N
  source 1..732: mol_type = other RNA
atgagctacgaggagatcgccgtgcagttcgccagcgagagcatcgacgagcaggccgtggccggctgggtgaccgacttcgcctaccagggcttcgacgccaagagagtgatcgccctggtgaaggacagaggcggcgaggactggaagcaggacgtgaagaagatgatcgtgctgagcctgaccagaggcaacaagcccaacaagatggtgctgaagatgagcgacaagggcaaggccatggtgaacgagctggtgctgaagtacaagctgaagagcggcaaccccagcagagacgacctgaccctgagcagaatcaccgccgccttcgccggctggacctgccaggccgccgactacgtgcaggagtacctgcccgtgaccggcagagccatggacgccatcagcagcagctaccccagagccatgatgcaccccagcttcgccggcctgatcgaccaggagctgcccgccgacgtgctgagcgagatcacccaggcccactgcctgttcatgatccagttcagcaagaccatcaaccccagcctgagaggcctgagcaaggacgagatcgtgagcagcttcgagagacccatgcaggccgccatcagcagcaccttcctgaccagcgccaacagaagagccatgctgaagaccctgggcatcatcaacgacaacctgaagcccagcagcagcaccgtgagcgccgccaaggtgttcagaagcctgtga

SEQ ID NO: 5511 - RNA, 732 nt, synthetic construct
  misc_feature 1..732: note = derived and/or modified CDS sequence (opt4) from PTV(Adames)__KR912210.1__N
  source 1..732: mol_type = other RNA
atgagctacgaggagatcgccgtgcagttcgccagcgagagcatcgacgagcaggccgtggccggctgggtgaccgacttcgcctaccagggcttcgacgccaagagagtgatcgccctggtgaaggagagaggcggcgaggactggaagcaggacgtgaagaagatgatcgtgctgagcctgaccagaggcaacaagcccaacaagatggtgctgaagatgagcgacaagggcaaggccatggtgaacgagctggtgctgaagtacaagctgaagagcggcaaccccagcagagacgacctgaccctgagcagaatcaccgccgccttcgccggctggacctgccaggccgccgactacgtgcaggagtacctgcccgtgaccggcagagccatggacaccatcagcagcggctaccccagagccatgatgcaccccagcttcgccggcctgatcgaccaggagctgcccgccgacgtgctgagcgagatcacccaggcccactgcctgttcatgatccagttcagcaagaccatcaaccccagcctgagaggcctgagcaaggacgagatcgtgagcagcttcgagagacccatgcaggccgccatcagcagcaccttcctgaccagcgccaacagaagagccatgctgaagaccctgggcatcatcaacgacaacctgaagcccagcagcagcaccgtgagcgccgccaaggtgttcagaagcctgtga

SEQ ID NO: 5512 - RNA, 732 nt, synthetic construct
  misc_feature 1..732: note = derived and/or modified CDS sequence (opt4) from PTV(Balliet)__KR912211.1__N
  source 1..732: mol_type = other RNA
atgagctacgaggagatcgccgtgcagttcgccagcgagagcatcgacgagcagaccgtggccggctgggtgaccgacttcgcctaccagggcttcgacgccaagagagtgatcgccctggtgaaggacagaggcggcgaggactggaagcaggacgtgaagaagatgatcgtgctgagcctgaccagaggcaacaagcccaacaagatgatcctgaagatgagcgacaagggcaaggccatggtgaacgagctggtgctgaagtacaagctgaagagcggcaaccccagcagagacgacctgaccctgagcagaatcaccgccgccttcgccggctggacctgccaggccgccgactacgtgcaggagtacctgcccgtgaccggcagagccatggacgccatcagcagcagctaccccagagccatgatgcaccccagcttcgccggcctgatcgaccaggagctgcccgccgacgtgttcagcgagatcacccaggcccactgcctgttcatgatccagttcagcaagaccatcaaccccagcctgagaggcctgagcaaggacgagatcgtgagcagcttcgagagacccatgcaggccgccatcagcagcaccttcctgaccagcgccaacagaagagccatgctgaagaccctgggcatcatcaacgacaacctgaagcccagcagcagcaccgtgagcgccgccaaggtgttcagaagcctgtga

SEQ ID NO: 5513 - RNA, 732 nt, synthetic construct
  misc_feature 1..732: note = derived and/or modified CDS sequence (opt4) from PTV(PaAR2381)__KP272006.1__N
  source 1..732: mol_type = other RNA
atgagctacgaggagatcgccgtgcagttcgccagcgagagcatcgacgagcaggccgtggccggctgggtgaccgacttcgcctaccagggcttcgacgccaagagagtgatcgccctggtgaaggacagaggcggcgacgactggaagcaggacgtgaagaagatgatcgtgctgagcctgaccagaggcaacaagcccaacaagatggtgctgaagatgagcgacaagggcaaggccatggtgaacgagctggtgctgaagtacaagctgaagagcggcaaccccagcagagacgacctgaccctgagcagaatcaccgccgccttcgccggctggacctgccaggccgccgactacgtgcaggagtacctgcccgtgaccggcagagccatggacgccatcagcagcagctaccccagagccatgatgcaccccagcttcgccggcctgatcgaccaggagctgcccgccgacgtgctgagcgagatcacccaggcccactgcctgttcatgatccagttcagcaagaccatcaaccccagcctgagaggcctgagcaaggacgagatcgtgagcagcttcgagagacccatgcaggccgccatcagcagcaccttcctgaccagcgccaacagaagagccatgctgaagaccctgggcatcatcaacgacaacctgaagcccagcagcagcaccgtgagcgccgccaaggtgttcagaagcctgtga

SEQ ID NO: 5514 - RNA, 732 nt, synthetic construct
  misc_feature 1..732: note = derived and/or modified CDS sequence (opt4) from PTV(GML902876)__KP272012.1__N
  source 1..732: mol_type = other RNA
atgagctacgaggagatcgccgtgcagttcgccagcgagagcatcgacgagcaggccgtggccggctgggtgaccgacttcgcctaccagggcttcgacgccaagagagtgatcgccctggtgaaggacagaggcggcgacgactggaagcaggacgtgaagaagatgatcgtgctgagcctgaccagaggcaacaagcccaacaagatggtgctgaagatgagcgacaagggcaaggccatggtgaacgagctggtgctgaagtacaagctgaagagcggcaaccccagcagagacgacctgaccctgagcagaatcaccgccgccttcgccggctggacctgccaggccgccgactacgtgcaggagtacctgcccgtgaccggcagagccatggacgccatcagcagcagctaccccagagccatgatgcaccccagcttcgccggcctgatcgaccaggagctgcccgccgacgtgctgagcgagatcacccaggcccactgcctgttcatgatccagttcagcaagaccatcaaccccagcctgagaggcctgagcaaggacgagatcgtgagcagcttcgagagacccatgcaggccgccatcagcagcaccttcctgaccagcgccaacagaagagccatgctgaagaccctgggcatcatcaacgacaacctgaagcccagcagcagcaccgccagcgccgccaaggtgttcagaagcctgtga

SEQ ID NO: 5515 - RNA, 732 nt, synthetic construct
  misc_feature 1..732: note = derived and/or modified CDS sequence (opt4) from PTV(Adames)__KP272030.1__N
  source 1..732: mol_type = other RNA
atgagctacgaggagatcgccgtgcagttcgccagcgagagcatcgacgagcaggccgtggccggctgggtgacccacttcgcctaccagggcttcgacgccaagagagtgatcgccctggtgaaggagagaggcggcgaggactggaagcaggacgtgaagaagatgatcgtgctgagcctgaccagaggcaacaagcccaacaagatggtgctgaagatgagcgacaagggcaaggccatggtgaacgagctggtgctgaagtacaagctgaagagcggcaaccccagcagagacgacctgaccctgagcagaatcaccgccgccttcgccggctggacctgccaggccgccgactacgtgcaggagtacctgcccgtgaccggcagagccatggacaccatcagcagcggctaccccagagccatgatgcaccccagcttcgccggcctgatcgaccaggagctgcccgccgacgtgctgagcgagatcacccaggcccactgcctgttcatgatccagttcagcaagaccatcaaccccagcctgagaggcctgagcaaggacgagatcgtgagcagcttcgagagacccatgcaggccgccatcagcagcaccttcctgaccagcgccaacagaagagccatgctgaagaccctgggcatcatcaacgacaacctgaagcccagcagcagcaccgtgagcgccgccaaggtgttcagaagcctgtga

SEQ ID NO: 5516 - RNA, 735 nt, synthetic construct
  misc_feature 1..735: note = derived and/or modified CDS sequence (opt4) from Phlebovirus(CoAr171616)__HM566153.1__N
  source 1..735: mol_type = other RNA
atgagctacgaggagatcgccgtgaacttcgccagcgagagcatcgacgagagcaccatcagcgcctgggtgagcgacttcgcctaccagggcttcgacgccaagagagtgatcgccctgatcaaggagagaggcggcgagaactggaaggaggacgtgaagaagatgatcgtgctgagcctgaccagaggcaacaagcccgccaagatgatcctgaagatgagcgacaagggcaagaaggaggtgaacgacctgatcaccagatacaagctgaagagcggcaaccccagcagagacgacctgaccctgagcagagtggccgccgccttcgccggctggacctgccaggccgccgagtacgtgcaggagtacctgcccgtgaccggcagagccatggacgccttcagcgccgacttccccagagccctgatgcaccccagcttcgccggcctgatcgaccaggagctgcccagcagcgccatgaccgacatcgtgcacgcccactgcctgttcatgatccagttcagcaagaccatcaaccccaccatcagaagcgccagcaaggacgagatcgtggccagcttcgacagacccatgcaggccgccatcaacagcaccttcctgaccagcgcccagagaagagccatgctgaagaccctgggcgtgatcaacgacaacctgaaggtgagcaccgccgtgagcagcgccgccaaggccttcaagaagctgcagtga

SEQ ID NO: 5517 - RNA, 735 nt, synthetic construct
  misc_feature 1..735: note = derived and/or modified CDS sequence (opt4) from Phlebovirus(CoAr171616)__EF201836.1__N
  source 1..735: mol_type = other RNA
atgagctacgaggagatcgccatccacttcgccagcgagagcatcgacgagagcaccatcagcgcctgggtgagcgacttcgcctaccagggcttcgacgccaagagagtgatcgccctgatcaaggagagaggcggcgagaactggaaggaggacgtgaagaagatgatcgtgctgagcctgaccagaggcaacaagcccgccaagatgatcctgaagatgagcgacaagggcaagaaggaggtgaacgacctgatcaccagatacaagctgaagagcggcaaccccagcagagacgacctgaccctgagcagagtggccgccgccttcgccggctggacctgccaggccgccgagtacgtgcaggagtacctgcccgtgaccggcagagccatggacgccttcagcgccgacttccccagagccctgatgcaccccagcttcgccggcctgatcgaccaggagctgcccagcagcgccatgaccgacatcgtgcacgcccactgcctgttcatgatccagttcagcaagaccatcaaccccaccatcagaagcgccagcaaggacgagatcgtggccagcttcgacagacccatgcaggccgccatcaacagcaccttcctgaccagcgcccagagaagagccatgctgaagaccctgggcgtgatcaacgacaacctgaaggtgagcaccgccgtgagcagcgccgccaaggccttcaagaagctgcagtga

SEQ ID NO: 5518 - RNA, 732 nt, synthetic construct
  misc_feature 1..732: note = derived and/or modified CDS sequence (opt4) from Phlebovirus(CoAr170255)__EF201840.1__N
  source 1..732: mol_type = other RNA
atgagctacgaggagatcgccatccagttcgccagcgagagcgtggacgccaccaccatcgccgcctgggtgagcgagttcgcctaccagggcttcgacgccagacaggtgatcaacctggtgaagcagagaggcggcgacgactggaaggaggacgtgaagaagatgatcgtgctgagcctgaccagaggcaacaagcccagcaagatgctgaacaagatgagcgagagcggccagaagatcgtgaacgacctgatcagcaagtacaagctgaagagcggcaaccccggcagaaacgacctgaccctgagcagaatcgccgccgccttcgccggctggacctgccaggccgccgaggtggtgcaggactacctgcccgtgaccggcagagccatggacgccatcagcgacaagttccccagagccctgatgcaccccagcttcgccggcctggtggaccccaccctgcccgagggcgtggtggaggacatcgtgcacgcccactgcctgttcatgatccagttcagcaagaccatcaaccccagcctgagaagcagcagcaagagcgaggtggtgagcagcttcgacagacccatgcaggccgccatcaacagccccttcctgaccgccggcaacagaagagacatcctgatgagcctgggcctgatcaacagcaacctgaagcccagccccgccgtgatcgccgccgccaaggtgtacagaaagctgtga

SEQ ID NO: 5519 - RNA, 732 nt, synthetic construct
  misc_feature 1..732: note = derived and/or modified CDS sequence (opt4) from Buenaventura virus(CoAr3319)__KP272003.1__N
  source 1..732: mol_type = other RNA
atgagctacgaggagatcgccatccagttcgccagcgagagcgtggacgccaccaccatcgccgcctgggtgagcgagttcgcctaccagggcttcgacgccagacaggtgatcaacctggtgaagcagagaggcggcgacgactggaaggaggacgtgaagaagatgatcgtgctgagcctgaccagaggcaacaagcccagcaagatgctgaacaagatgagcgagagcggccagaagatcgtgaacgacctgatcagcaagtacaagctgaagagcggcaaccccggcagaaacgacctgaccctgagcagaatcgccgccgccttcgccggctggacctgccaggccgccgaggtggtgcaggactacctgcccgtgaccggcagagccatggacgccatcagcgacaagttccccagagccctgatgcaccccagcttcgccggcctggtggaccccaccctgcccgagggcgtggtggaggacatcgtgcacgcccactgcctgttcatgatccagttcagcaagaccatcaaccccagcctgagaagcagcagcaagagcgaggtggtgagcagcttcgacagacccatgcaggccgccatcaacagccccttcctgaccgccggcaacagaagagacatcctgatgagcctgggcctgatcaacagcaacctgaagcccagccccaccgtggtggccgccgccaaggtgtacagaaagctgtga

SEQ ID NO: 5520 - RNA, 732 nt, synthetic construct
  misc_feature 1..732: note = derived and/or modified CDS sequence (opt4) from Cocle virus(GML244915)__KP272035.1__N
  source 1..732: mol_type = other RNA
atgagctacgaggagatcgccgtgcagttcgccagcgagagcatcgacgagcaggccgtggccggctgggtgaccgacttcgcctaccagggcttcgacgccagaagagtgatcgccctggtgaaggacagaggcggcgaggactggaagcaggacgtgaagaagatgatcgtgctgagcctgaccagaggcaacaagcccaacaagatggtgctgaagatgagcgacaagggcaaggccatggtgaacgagctggtgctgaagtacaagctgaagagcggcaaccccagcagagacgacctgaccctgagcagaatcaccgccgccttcgccggctggacctgccaggccgccgactacgtgcaggagtacctgcccgtgaccggcagagccatggacgccatcagcagcggctaccccagagccatgatgcaccccagcttcgccggcctgatcgaccaggagctgcccgccgacgtgctgagcgagatcacccaggcccactgcctgttcatgatccagttcagcaagaccatcaaccccagcctgagaggcctgggcaaggacgagatcgtgagcagcttcgagagacccatgcaggccgccatcagcagcaccttcctgaccagcgccaacagaagagccatgctgaagaccctgggcatcatcaacgacaacctgaagcccagcagcagcaccgtgagcgccgccaaggtgttcagaagcctgtga

SEQ ID NO: 5521 - RNA, 732 nt, synthetic construct
  misc_feature 1..732: note = derived and/or modified CDS sequence (opt4) from Capira virus(VP-366G)__KP272044.1__N
  source 1..732: mol_type = other RNA
atgagctacgaggagatcgccatccagttcgccagcgagagcatcgacgagagcaccatcgccgcctgggtgagcgacttcgcctaccagggcttcgacgccaagcaggtgatcatcctgatcaagaagagaggcggcgagaactggaaggaggacgtgaagaagatgatcgtgctgagcctgaccagaggcaacaagcccagcaagatggtgaacaagatgagcgacgagggcaagaaggtggtgaacgagctgatcagcaagtacaagctgaagaccggcaaccccgccagagacgacctgaccctgagcagaatcgccgccgccttcgccggctggacctgccaggccgccgagtacgtgcaggactacctgcccgtgaccggcagagccatggacgccctgagcgacaagtaccccagagccctgatgcaccccagcttcgccggcctgatcgaccccaccctgcccgacgacgccgtgaaggacatcgtgcacgcccactgcctgttcatgatccagttcagcaagaccatcaaccccagcctgagaagcagcaccaagaccgagatcgtgaacagcttcgacagacccatgcaggccgccatcaacagccccttcctgaccgccgagaacagaagagccatgctgaccaccctgggcgtgatcaacagcaacctgaagcccagcgccgccgtggtggccgccgccaaggcctacagaaagctgtga

SEQ ID NO: 5522 - RNA, 732 nt, synthetic construct
  misc_feature 1..732: note = derived and/or modified CDS sequence (opt4) from Campana virus(VP-334K)__KP272042.1__N
  source 1..732: mol_type = other RNA
atgagctacgaggagatcgccatccagttcgccagcgagagcgtggacgccaccaccatcgccgcctgggtgagcgagttcgcctaccagggcttcgacgccagacaggtgatcaacctggtgaagcagagaggcggcgacgactggaaggaggacgtgaagaagatgatcgtgctgagcctgaccagaggcaacaagcccagcagaatggtgaccaagatgagcgagagcggccagaagatcgtgaacgacctgatcagcaagtacaagctgaagagcggcaaccccggcagaaacgacctgaccctgagcagagtggccgccgccttcgccggctggacctgccaggccgccgaggtggtgcaggactacctgcccgtgaccggcagagccatggacgccctgagcgacaagttccccagagccatcatgcaccccagcttcgccggcctgatcgaccccaccctgcccgagaacgtggtggaggacatcgtgcacgcccactgcctgttcatgatccagttcagcaagaccatcaaccccagcctgagaagcagcagcaagagcgaggtggtgagcagcttcgacagacccatgcaggccgccatcaacagccccttcctgaccgccgccaacagaagagacatgctgatgagcctgggcctgatcagcagcaacctgaagcccagcgccgccgtgaccgccgccgccaaggcctacagaaagctgtga

SEQ ID NO: 5523 - RNA, 738 nt, synthetic construct
  misc_feature 1..738: note = derived and/or modified CDS sequence (opt4) from RVFV(ZH-548)__DQ380151.1__N
  source 1..738: mol_type = other RNA
atggacaactaccaggagctggccatccagttcgccgcccaggccgtggacagaaacgagatcgagcagtgggtgagagagttcgcctaccagggcttcgacgccagaagagtgatcgagctgctgaagcagtacggcggcgccgactgggagaaggacgccaagaagatgatcgtgctggccctgaccagaggcaacaagcccagaagaatgatgatgaagatgagcaaggagggcaaggccaccgtggaggccctgatcaacaagtacaagctgaaggagggcaaccccagcagagacgagctgaccctgagcagagtggccgccgccctggccggctggacctgccaggccctggtggtgctgagcgagtggctgcccgtgaccggcaccaccatggacggcctgagccccgcctaccccagacacatgatgcaccccagcttcgccggcatggtggaccccagcctgcccggcgactacctgagagccatcctggacgcccacagcctgtacctgctgcagttcagcagagtgatcaaccccaacctgagaggcagaaccaaggaggaggtggccgccaccttcacccagcccatgaacgccgccgtgaacagcaacttcatcagccacgagaagagaagagagttcctgaaggccttcggcctggtggacagcaacggcaagcccagcgccgccgtgatggccgccgcccaggcctacaagaccgccgcctga

SEQ ID NO: 5524 - RNA, 738 nt, synthetic construct
  misc_feature 1..738: note = derived and/or modified CDS sequence (opt4) from RVFV(OV 35/74)__EF530207.1__N
  source 1..738: mol_type = other RNA
atggacaactaccaggagctggccatccagttcgccgcccaggccgtggacagaaacgagatcgagcagtgggtgagagagttcgcctaccagggcttcgacgccagaagagtgatcgagctgctgaagcagtacggcggcgccgactgggagaaggacgccaagaagatgatcgtgctggccctgaccagaggcaacaagcccagaagaatgatgatgaagatgagcaaggagggcaaggccaccgtggaggccctgatcaacaagtacaagctgaaggagggcaaccccagcagagacgagctgaccctgagcagagtggccgccgccctggccggctggacctgccaggccctggtggtgctgagcgagtggctgcccgtgaccggcaccaccatggacggcctgagccccgcctaccccagacacatgatgcaccccagcttcgccggcatggtggaccccagcctgcccgaggactacctgagagccatcctggacgcccacagcctgtacctgctgcagttcagcagagtgatcaaccccaacctgagaggcagaaccaaggaggaggtggccgccaccttcacccagcccatgaacgccgccgtgaacagcaacttcatcagccacgagaagagaagagagttcctgaaggccttcggcctggtggacagcaacggcaagcccagcgccgccgtgatggccgccgcccaggcctacaagaccgccgcctga

SEQ ID NO: 5525 - RNA, 762 nt, synthetic construct
  misc_feature 1..762: note = derived and/or modified CDS sequence (opt4) from SFNV(Toscana)__NC_006318.1__N
  source 1..762: mol_type = other RNA
atgagcgacgagaactacagagacatcgccctggccttcctggacgagagcgccgacagcggcaccatcaacgcctgggtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgaggccatgatgaagaagatgagcgagaagggcgccagcatcgtggccaacctgatcagcgtgtaccagctgaaggagggcaaccccggcagagacaccatcaccctgagcagagtgagcgccgccttcgtgccctggaccgtgcaggccctgagagtgctgagcgagagcctgcccgtgagcggcaccaccatggacgccatcgccggcgtgacctaccccagagccatgatgcaccccagcttcgccggcatcatcgacctggacctgcccaacggcgccggcgccaccatcgccgacgcccacggcctgttcatgatcgagttcagcaagaccatcaaccccagcctgagaaccaagcaggccaacgaggtggccgccaccttcgagaagcccaacatggccgccatgagcggcagattcttcaccagagaggacaagaagaagctgctgatcgccgtgggcatcatcgacgaggacctggtgctggccagcgccgtggtgagaagcgccgagaagtacagagccaaggtgggcaagtga

SEQ ID NO: 5526 - RNA, 762 nt, synthetic construct
  misc_feature 1..762: note = derived and/or modified CDS sequence (opt4) from SFNV__HM566170.1__N
  source 1..762: mol_type = other RNA
atgagcgaggagaactacagagagatcgccctggccttcctggacgaggccgccgacagcggcaccatcaccgcctgggtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgaggccatgatgaagaagatgagcgagaagggcgccggcatcgtggcccagctgatcagcgtgtaccagctgaaggagggcaaccccggcagagacaccatcaccctgagcagagtgagcgccgccttcgtgccctggaccatccaggccctgagagtgctgagcgacagcctgcccgtgaccggcaccaccatggacgccatcgccggcgtgacctaccccagagccatgatgcaccccagcttcgccggcatcatcgacctggacctgcccaacagagccggcgaggtgatcgccgacgcccacggcctgttcatgctggagttcagcaagaccatcaaccccagcctgagaaccaagcagcccaacgagatcgccgccaccttcgagaagcccaacatggccgccatgagcggcagattcttcaccagagaggacaagaagaagctgctgatggccgtgggcatcctgaacgaggacctggtgctgacccccgccatcgtgaagtgcgccgagaagtactgcagcaaggtgggcaagtga

SEQ ID NO: 5527 - RNA, 735 nt, synthetic construct; identical to SEQ ID NO: 5516
  misc_feature 1..735: note = derived and/or modified CDS sequence (opt4) from SFNV(Namru)__HM566168.1__N
  source 1..735: mol_type = other RNA

SEQ ID NO: 5528 - RNA, 762 nt, synthetic construct
  misc_feature 1..762: note = derived and/or modified CDS sequence (opt4) from SFNV(NAMRU 840055)__EF201828.1__N
  source 1..762: mol_type = other RNA
atgagcgaggagaactacagagagatcgccctggccttcctggacgaggccgccgacagcggcaccatcaccgcctgggtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgaggccatgatgaagaagatgagcgagaagggcgccggcatcgtggcccagctgatcagcgtgtaccagctgagagagggcaaccccggcagagacaccatcaccctgagcagagtgagcgccgccttcgtgccctggaccatccaggccctgaaggtgctgagcgacagcctgcccgtgaccggcaccaccatggacgccatcgccggcgtggtgtaccccagagccatgatgcaccccagcttcgccggcatcatcgacctggacctgcccaacagagccggcgaggccatcgccgacgcccacggcctgttcatgctggagttcagcaagaccatcaaccccagcctgagaaccaagcagcccaacgagatcgccgccaccttcgagaagcccaacatggccgccatgagcggcagattcttcaccagagaggacaagaagaagctgctgatggccgtgggcatcctgaacgaggacctggtgctgacccccgccatcgtgaagtgcgccgagaagtacagaagcaaggtgggcaagtga

SEQ ID NO: 5529 - RNA, 762 nt, synthetic construct
  misc_feature 1..762: note = derived and/or modified CDS sequence (opt4) from SFNV(NAMRU 840055)__EF201829.1__N
  source 1..762: mol_type = other RNA
atgagcgaggagaactacagagagatcgccctggccttcctggacgaggccgccgacagcggcaccatcaccgcctgggtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgaggccatgatgaagaagatgagcgagaagggcgccggcatcgtggcccagctgatcagcgtgtaccagctgaaggagggcaaccccggcagagacaccatcaccctgagcagagtgagcgccgccttcgtgccctggaccatccaggccctgagagtgctgagcgacagcctgcccgtgaccggcaccaccatggacgccatcgccggcgtgacctaccccagagccatgatgcaccccagcttcgccggcatcatcgacctggacctgcccaacagagccggcgaggccatcgccgacgcccacggcctgttcatgctggagttcagcaagaccatcaaccccagcctgagaaccaagcagcccaacgagatcgccgccaccttcgagaagcccaacatggccgccatgagcggcagattcttcaccagagaggacaagaagaagctgctgatggccgtgggcatcctgaacgaggacctggtgctgacccccgccatcgtgaagtgcgccgagaagtactgcagcaaggtgggcaagtga

SEQ ID NO: 5530 - RNA, 762 nt, synthetic construct
  misc_feature 1..762: note = derived and/or modified CDS sequence (opt4) from SFNV(P-7101795)__EF201830.1__N
  source 1..762: mol_type = other RNA
atgagcgaggagaactacagagagatcgccctggccttcctgaacgaggccgccgacagcggcaccatcaccgcctgggtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgagaccatgatgaagaagatgagcgagaagggcgccggcatcgtggcccagctgatcagcgtgtaccagctgaaggagggcaaccccggcagagacaccatcaccctgagcagagtgagcgccgccttcgtgccctggaccgtgcaggccctgagagtgctgagcgacagcctgcccgtgaccggcaccaccatggacgccatcgccggcgtgacctaccccagagccatgatgcaccccagcttcgccggcatcatcgacctggacctgcccaacagagccggcgagaccatcgccgacgcccacggcctgttcatgctggagttcagcaagaccatcaaccccagcctgagaaccaagcagcccaacgagatcgccgccaccttcgagaagcccaacatggccgccatgagcggcagattcttcaccagagaggacaagaagaagctgctgatggccgtgggcgtgctgaacgaggacctggtgctgacccccgccatcgtgaagtgcgccgagaagtacagaagcaaggtgggcaagtga

SEQ ID NO: 5531 - RNA, 762 nt, synthetic construct
  misc_feature 1..762: note = derived and/or modified CDS sequence (opt4) from SFNV(P-7101795)__EF201832.1__N
  source 1..762: mol_type = other RNA
atgagcgaggagaactacagagagatcgccctggccttcctggacgaggccgccgacagcggcaccatcaccgcctgggtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgaggccatgatgaagaagatgagcgagaagggcgccggcatcgtggcccagctgatcagcgtgtaccagctgagagagggcaaccccggcagagacaccatcaccctgagcagagtgagcgccgccttcgtgccctggaccatccaggccctgaaggtgctgagcgacagcctgcccgtgaccggcaccaccatggacgccatcgccggcgtgatgtaccccagagccatgatgcaccccagcttcgccggcatcatcgacctggacctgcccaacagagccggcgaggccatcgccgacgcccacggcctgttcatgctggagttcagcaagaccatcaaccccagcctgagaaccaagcagcccaacgagatcgccgccaccttcgagaagcccaacatggccgccatgagcggcagattcttcaccagagaggacaagaagaagctgctgatggccgtgggcatcctgaacgaggacctggtgctgacccccgccatcatcaagtgcgccgagaagtacagaagcaaggtgggcaagtga

SEQ ID NO: 5532 - RNA, 762 nt, synthetic construct
  misc_feature 1..762: note = derived and/or modified CDS sequence (opt4) from Arrabida virus(PoSFPhlebV/126/2008)__KP863801.1__N
  source 1..762: mol_type = other RNA
atgagcgaggacaactacagaaccatcgccctggccttcctggacgagagcgccgacagcaccaccatcaacgcctgggtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgagagcatgatgaagaagatgagcgagaagggcgccgccatcgtgacccagctgatcagcacctaccagctgaaggagggcaaccccggcagagacaccatcaccctgagcagagtgagcgccgccttcgtgccctggaccgtgcaggccctgaagaccctgagcgagagcctgcccgtgaccggcaccaccatggacagcatcgccggcaccacctaccccagatgcatgatgcaccccagcttcgccggcatcatcgacctggagctgcccaacaacaccggcgccatgctggccgacgcccacggcctgttcatgctggagttcagcaagaccatcaaccccagcctgagaaccaagcagcccaacgagatcgccgccaccttcgagaagcccaacatggccgccatgaccggcagattcttcaccagagacgacaagaagaagctgctgatcgccatcggcgtgctggacgaggacctggtgcccaaccccgccatcgagaagtgcgccgagaagtacaaggccaaggtgggcaagtga

SEQ ID NO: 5533 - RNA, 765 nt, synthetic construct
  misc_feature 1..765: note = derived and/or modified CDS sequence (opt4) from Gordil virus(Dak ANBr 496d)__KF297902.1__N
  source 1..765: mol_type = other RNA
atgagcgaggagaactacagagagatcgccatggccttcgccaacgacagcgccgacttcaacatgatcagcgtgtgggccaacgacttcgcctaccagggcttcgaccccaagagaatcgtggagctggtgagacagagaggcctggccaaggccagaaactggaagcaggacgtgaagatgatgatcgtgctgaacctgatgagaggcaacaagcccgaggccatggtgagaaagatgcaggagaagggccagagaatcgtgctggagctgatcagcgtgtacgagctgaaggagggcaaccccggcagagacaccatcaccctgagcagagtgagcgccgccttcgtgccctggaccatcatggccctgagacagctggccgagaacatccccgtgaccggcagcatcatggacagcatcctggacggcgccgtgtaccccagagccatgatgcaccccagcttcgccggcatcatcgacctggagctgcccgagggcagaggcgccgagctggccgacgcccacggcctgttcatgatcgagttcagcaagaccatcaaccccagcctgagaaccaagagcgccatcgagatcgccgccagcttcgagaagcccaacatggccgccatgaccggcaacttcttcaccaaggacgacaagagaaagctgctgaagcagatcggcatcctggacagcgacctgaagctgacccccgtgatcgagaaggccgccgccctgtacagaagcaagaccaacaagtga

SEQ ID NO: 5534 - RNA, 762 nt, synthetic construct
  misc_feature 1..762: note = derived and/or modified CDS sequence (opt4) from Granada virus(GR25)__GU135608.1__N
  source 1..762: mol_type = other RNA
atgagcgaggacaactacagaaccatcgccctggccttcctggacgagagcgccgacagcaccaccatcaacgcctgggtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgagagcatgatgaagaagatgagcgagaagggcgccgccatcgtgacccagctgatcagcacctaccagctgaaggagggcaaccccggcagagacaccatcaccctgagcagagtgagcgccgccttcgtgccctggaccgtgcaggccctgaagaccctgagcgagagcctgcccgtgaccggcaccaccatggacagcatcgccggcaccacctaccccagatgcatgatgcaccccagcttcgccggcatcatcgacctggagctgcccaacaacaccggcgccatgctggccgacgcccacggcctgttcatgctggagttcagcaagaccatcaaccccagcctgagaaccaagcagcccaacgagatcgccgccaccttcgagaagcccaacatggccgccatgaccggcagattcttcaccagagacgacaagaagaagctgctgatcgccatcggcgtgctgaacgaggacctggtgcccaaccccgccatcgagaagtgcgccgagaagtacaaggccaaggtgggcaagtga

SEQ ID NO: 5535 - RNA, 762 nt, synthetic construct
  misc_feature 1..762: note = derived and/or modified CDS sequence (opt4) from Massilia virus(127)__KT906102.1__N
  source 1..762: mol_type = other RNA
atgagcgaggacaactacagaaccatcgccctgagcttcctggacgagaccgccgtgagcaccagcatcaacgcctgcgtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgagagcatgatgaagaagatgagcgagaagggcgccgccatcgtgacccagctgatcagcacctaccagctgaaggagggcaaccccggcagagacaccatcaccctgagcagagtgagcgccgccttcgtgccctggaccgtgcaggccctgaagaccctgagcgagagcctgcccgtgaccggcaccaccatggacagcatcgccggcaccacctaccccagatgcatgatgcaccccagcttcgccggcatcatcgacctggagctgcccaacaacaccggcgccatgctggccgacgcccacggcctgttcatgctggagttcagcaagaccatcaaccccagcctgagaaccaagcagcccaacgagatcgccgccaccttcgagaagcccaacatggccgccatgaccggcagattcttcaccagagacgacaagaagaagctgctgatcgccatcggcgtgctggacgaggacctggtgcccaaccccgccatcgagaagtgcgccgagaagtacaaggccaaggtgggcaagtga

SEQ ID NO: 5536 - RNA, 762 nt, synthetic construct
  misc_feature 1..762: note = derived and/or modified CDS sequence (opt4) from Massilia virus(130)__KT906103.1__N
  source 1..762: mol_type = other RNA
atgagcgaggacaactacagaaccatcgccctgagcttcctggacgagaccgccgacagcaccagcatcaacgcctgcgtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgagagcatgatgaagaagatgagcgagaagggcgccgccatcgtgacccagctgatcagcacctaccagctgaaggagggcaaccccggcagagacaccatcaccctgagcagagtgagcgccgccttcgtgccctggaccgtgcaggccctgaagaccctgagcgagagcctgcccgtgaccggcaccaccatggacagcatcgccggcaccacctaccccagatgcatgatgcaccccagcttcgccggcatcatcgacctggagctgcccaacaacaccggcgccatgctggccgacgcccacggcctgttcatgctggagttcagcaagaccatcaaccccagcctgagaaccaagcagcccaacgagatcgccgccaccttcgagaagcccaacatggccgccatgaccggcagattcttcaccagagacgacaagaagaagctgctgatcgccatcggcgtgctggacgaggacctggtgcccaaccccgccatcgagaagtgcgccgagaagtacaaggccaaggtgggcaagtga

SEQ ID NO: 5537 - RNA, 762 nt, synthetic construct
  misc_feature 1..762: note = derived and/or modified CDS sequence (opt4) from Naples virus(Yu 8/76)__JF920141.1__N
  source 1..762: mol_type = other RNA
atgagcgaggacgactaccacaagatcgccctggccttcgccgaggagagcgccgacgtgagcaccatcgagagctgggtgaacgacttcgcctaccagggcttcgaccccagaagaatcgtgcagctggtgaaggagagaggcaccgccaagggcagagactggaagaaggacgtgaagatgatgatcgtgctgaacctggtgagaggcaacaagcccgaggccatgatgaagaagatgagcgagaagggcgccgccatcgtggcccagctgatcagcgtgtaccagctgaaggagggcaaccccggcagagacaccatcaccctgagcagagtgagcgccgccttcgtgccctggaccgtgcaggccctgagagtgctgagcgaccacctgcccgtgaccggcaccaccatggacgccatcgccggcgtgacctaccccagagccatgatgcaccccagcttcgccggcatcgtggacctggagctgcccagaaagaccggcgagatgatcgccgacgcccacggcctgttcatgctggagttcagcaagaccatcaaccccagcctgagaaccaagcagcccaacgagatcgccaccaccttcgagaagcccaacatggccgccatgagcggcaagttcttcagcagagaggacaagaagaagctgctgatgagcgtgggcatcatcaacgacgacctgctgctgaccgccagcgtggtgaagtgcgccgagaagtacagagccaagaccggcaagtga

SEQ ID NO: 5538 - RNA, 762 nt, synthetic construct
  misc_feature 1..762: note = derived and/or modified CDS sequence (opt4) from Punique virus(P1_B4_2008)__FJ848987.1__N
  source 1..762: mol_type = other RNA
atgagcgaggagaactacagagagatcgccctggccttcctggacgagagcgccgacagcggcaccatcagcacctgggtgaacgacttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgagagcatgatgaagaagatgagcgagaagggcgccgccatcgtggcccagctgatcgccgcctaccagctgaaggagggcaaccccggcagagacaccatcaccctgagcagagtgagcgccgccttcgtgccctggaccgtgcaggccctgagaagcctgagcgacagcctgcccgtgaccggcaccaccatggacagcatcgccggcgtgacctaccccagatgcatgatgcaccccagcttcgccggcatcatcgacctggacctgcccaacgacaccggcgccatgctggccgacgcccacggcctgttcatgctggagttcagcaagaccatcaaccccagcctgagaaccaagcaggccaacgagatcgccgccaccttcgagaagcccaacatggccgccatgaacggcagattcttcaccagagaggacaagaagaagctgctgatcgccatcggcgtgctgaacgaggacctgatccccgtgagcgccatcgccaagtgcgccgagaagtacagagccaaggtgggcaagtga

SEQ ID NO: 5539 - RNA, 762 nt, synthetic construct
  misc_feature 1..762: note = derived and/or modified CDS sequence (opt4) from Saint Floris virus(Dak ANB512)__JF920138.1__N
  source 1..762: mol_type = other RNA
atgagcgaggagacctacgcccagctggccatggccttcctggccgagcccgccgactggagcaccctgagcgtgtgggtgaacgagttcgcctaccagggcttcgaccccaagagaatcgtggagctgatcatggagagaggcaagaagttcaacagagagtggaagaaggacgtgaagatgatgatcaccctgaacctgatcagaggcaacaagcccgaggccatgatgagaaagatgagcgacaagggcagaagcatcgtgagcgagctgatcagcgtgtacgagctgaaggagggcaaccccggcagagacaccatcaccctgagcagagtgagcgccgccttcgtgccctggaccgtgagagccctggtggccctgcagaacgacctgcccgtgaccggcgccgccatggacagcatctgcggcgtgacctaccccagagccatgatgcaccccagcttcgccggcgtgatcgacctggagctgcccaacggcgtgggcgcccagctggccgacgcccacggcctgttcatgctggagttcagcaagaccatcaaccccggcctgagaaccaagcagcccaacgagatcgccgccaccttcgagaagcccaacctggccgccatgaccggcaagttcttcaccaaggaggacaagagaaaggtgctgatcagcgtgggcgtgatcaacagcgacctgcagcccaacagcgtggtgaagacctgcgccgagctgtacagagccagagtgatgaagtga

SEQ ID NO: 5540 - RNA, 762 nt, synthetic construct
  misc_feature 1..762: note = derived and/or modified CDS sequence (opt4) from Tehran virus(I-47)__JF939848.1__N
  source 1..762: mol_type = other RNA
atgagcgaggaggactacagagccatcgccctgagcttcagcgacgagagcgccgacgtgggcatcatcaccacctgggtgaacgagttcgcctaccagggcttcgaccccaagagaatcgtgcagctggtgaaggagagaggccaggccaagggcagagactggaagaaggacgtgaagatgatgatcgtgctgaacctgatcagaggcaacaagcccgacgccatgatgaagaagatgagcgagaagggcgccgccaccgtggcccagctggtgagcgtgtaccagctgaaggagggcaaccccggcagagacaccatcaccctgagcagagtgagcgccgccttcgtgccctggaccgtgcaggccctgaaggtgctgagcgagagcctgcccgtgaccggcaccaccatggacaccgtggccggcgtgacctaccccagagccatgatgcaccccagcttcgccggcatcatcgacctggagctgcccggcagagccggcgaggccatcgccgacgcccacggcctgttcatgctggagttcagcaagaccatcaaccccagcctgagaaccaagcagcccaacgagatcgccgccaccttcgagaagcccaacatggccgccatgaccggcagattcttcaccagagaggacaagaagaagctgctgatcgccgtgggcatcatcaacgacgacctgctgctgacccccagcatcgccaagtgcgccgagaagtacagagccaaggtgggcaagtga

SEQ ID NO: 5541 - RNA, 762 nt, synthetic construct
  misc_feature 1..762: note = derived and/or modified CDS sequence (opt4) from Zerdali virus(37)__KP966618.1__N
  source 1..762: mol_type = other RNA
atgagcgaggaggactacagagccatcgccctgagcttcagcgacgaggccgccgacgtgggcaccatcaccgcctgggtgaacgagttcgcctaccagggcttcgaccccaagagaatcgtgcagctggtgagagagagaggcatcgccaagggcagagactggaagaaggacgtgaagatgatgatcgtgctgaacctgatcagaggcaacaagcccgacgccatgatgaagaagatgagcgagaagggcgccgccaccgtggcccagctggtgagcgtgtaccagctgaaggagggcaaccccggcagagacaccatcacccccagcagagtgagcgccgccttcgtgccctggaccgtgcaggccctgaaggtgctgagcgagagcctgcccgtgaccggcaccaccatggacaccatcgccggcgtgagctaccccagagccatgatgcaccccagcttcgccggcatcatcgacctggagctgcccagaagagccggcgaggtgatcgccgacgcccacggcctgttcatgctggagttcagcaagaccatcaaccccagcctgagaaccaagcagcccaacgagatcgccgccaccttcgagaagcccaacatggccgccatgaccggcagattcttcaccagagaggacaagaagaagctgctgatcgccgtgggcatcatcaacgacgacctgctgctggcccccagcgtggccaagtgcgccgagaagtacagagccaaggtgggcaagtga

SEQ ID NO: 5542 - RNA, 762 nt, synthetic construct; identical to SEQ ID NO: 5525
  misc_feature 1..762: note = derived and/or modified CDS sequence (opt4) from TOSV(9028)__KU904263.1__N
  source 1..762: mol_type = other RNA

SEQ ID NO: 5543 - RNA, 762 nt, synthetic construct
  misc_feature 1..762: note = derived and/or modified CDS sequence (opt4) from TOSV(SI-121283)__JF330274.1__N
  source 1..762: mol_type = other RNA
atgagcgacgagaactacagagacatcgccctggccttcctggacgagagcgccgacagcggcaccatcaacgcctgggtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgaggccatgatgaagaagatgagcgagaagggcgccagcatcgtggccaacctgatcagcgtgtaccagctgaaggagggcaaccccggcagagacaccatcaccctgagcagagtgagcgccgccttcgtgccctggaccgtgcaggccctgagagtgctgagcgagagcctgcccgtgagcggcaccaccatggacgccatcgccggcgtgacctaccccagagccatgatgcaccccagcttcgccggcatcatcgacctggacctgcccaacggcgccggcgccaccatcgccgacgcccacggcctgttcatgatcgagttcagcaagaccatcaaccccagcctgagaaccaagcaggccaacgaggtggccgccaccttcgagaaccccaacatggccgccatgagcggcagattcttcaccagagaggacaagaagaagctgctgatcgccgtgggcatcatcgacgaggacctggtgctggccagcgccgtggtgagaagcgccgagaagtacagagccaaggtgggcaagtga

SEQ ID NO: 5544 - RNA, 762 nt, synthetic construct
  misc_feature 1..762: note = derived and/or modified CDS sequence (opt4) from TOSV(5963930705)__KU935733.1__N
  source 1..762: mol_type = other RNA
atgagcgacgagaactacagagacatcgccctggccttcctggacgagagcgccgacagcggcaccatcaacgcctgggtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgaggccatgatgaagaagatgagcgagaagggcgccagcatcgtggccaacctgatcagcgtgtaccagctgaaggagggcaaccccggcagagacaccatcaccctgagcagagtgagcgccgccttcgtgccctggaccgtgcaggccctgagagtgctgagcgagagcctgcccgtgagcggcaccaccatggacgccatcgccggcgtgacctaccccagagccatgatgcaccccagcttcgccggcatcatcgacctggacctgcccaacggcgccggcgccaccatcgccgacgcccacggcctgttcatggtggagttcagcaagaccatcaaccccagcctgagaaccaagcaggccaacgaggtggccgccaccttcgagaagcccaacatggccgccatgagcggcagattcttcaccagagaggacaagaagaagctgctgatcgccgtgggcatcatcgacgaggacctggtgctggccagcgccgtggtgagaagcgccgagaagtacagagccaaggtgggcaagtga

SEQ ID NO: 5545 - RNA, 762 nt, synthetic construct
  misc_feature 1..762: note = derived and/or modified CDS sequence (opt4) from TOSV(MRS2010-4319501)__KC776214.1__N
  source 1..762: mol_type = other RNA
atgagcgacgagaactacagagacatcgccctggccttcctggacgagagcgccgacagcggcaccatcaacgcctgggtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgaggccatgatgaagaagatgagcgagaagggcgccagcatcgtggccaacctgatcagcgtgtaccagctgaaggagggcaaccccggcagagacaccatcaccctgagcagagtgagcgccgccttcgtgccctggaccgtgcaggccctgagagtgctgagcgagagcctgcccgtgagcggcaccaccatggacgccatcgccggcgtgacctaccccagagccatgatgcaccccagcttcgccggcatcatcgacctgcacctgcccaacggcgccggcgccaccatcgccgacgcccacggcctgttcatgatcgagttcagcaagaccatcaaccccagcctgagaaccaagcaggccaacgaggtggccgccaccttcgagaagcccaacatggccgccatgagcggcagattcttcaccagagaggacaagaagaagctgctgatcgccgtgggcatcatcgacgaggacctggtgctggccagcgccgtggtgagaagcgccgagaagtacagagccaaggtgggcaagtga

SEQ ID NO: 5546 - RNA, 762 nt, synthetic construct
  misc_feature 1..762: note = derived and/or modified CDS sequence (opt4) from TOSV(TOSV/Firenze.ITA/1983/2)__KM275765.1__N
  source 1..762: mol_type = other RNA
atgagcgacgagaactacagagacatcgccctggccttcctggacgagtgcgccgacagcggcaccatcaacgcctgggtgaacgagttcgcctaccagggcttcgaccccaagagaatcgtgcagctggtgaaggagagaggcaccgccaagggcagagactggaagaaggacgtgaagatgatgatcgtgctgaacctggtgagaggcaacaagcccgaggccatgatgaagaagatgagcgagaagggcgccagcatcgtggccaacctgatcagcgtgtaccagctgaaggagggcaaccccggcagagacaccatcaccctgagcagagtgagcgccgccttcgtgccctggaccgtgcaggccctgagagtgctgagcgagagcctgcccgtgagcggcaccaccatggacgccatcgccggcgtgacctaccccagagccatgatgcaccccagcttcgccggcatcatcgacctggacctgcccaacggcgccggcgccaccatcgccgacgcccacggcctgttcatgatcgagttcagcaagaccatcaaccccagcctgagaaccaagcaggccaacgaggtggccgccaccttcgagaagcccaacatggccgccatgagcggcagattcttcaccagagaggacaagaagaagctgctgatcgccgtgggcatcatcgacgaggacctggtgctggccagcgccgtggtgagaagcgccgagaagtacagagccaaggtgggcaagtga

SEQ ID NO: 5547 - RNA, 738 nt, synthetic construct
  misc_feature 1..738: note = derived and/or modified CDS sequence (opt4) from SFTSV(HB29)__NC_018137.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5548 - RNA, 738 nt, synthetic construct
  misc_feature 1..738: note = derived and/or modified CDS sequence (opt4) from SFTSV(111S)__KP339904.1__N
  source 1..738: mol_type = other RNA
atgagcgagtggagcagaatcgccgtggagttcggcgagcagcagctgaacctgaccgagctggaggacttcgccagagagctggcctacgagggcctggacagagccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5549 - RNA, 738 nt, synthetic construct
  misc_feature 1..738: note = derived and/or modified CDS sequence (opt4) from SFTSV(116S)__KP339905.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgagatctacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5550 - RNA, 738 nt, synthetic construct
  misc_feature 1..738: note = derived and/or modified CDS sequence (opt4) from SFTSV(132S)__KP339912.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcagcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5551 - RNA, 738 nt, synthetic construct
  misc_feature 1..738: note = derived and/or modified CDS sequence (opt4) from SFTSV(2014045S)__KR075923.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgcccccagcagagccgccgaggtggccgccgccgcctacagaaacctgtga

SEQ ID NO: 5552 - RNA, 738 nt, synthetic construct
  misc_feature 1..738: note = derived and/or modified CDS sequence (opt4) from SFTSV(2014193S)__KR075916.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcgtgacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5553 - RNA, 738 nt, synthetic construct
  misc_feature 1..738: note = derived and/or modified CDS sequence (opt4) from SFTSV(2015SH232S)__KT736097.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgagatggctgaaggccaagggcatcctgggccccgacggcgtgcccagcagagccgccgaggtggccgccgccgcctacagaaacctgtga

SEQ ID NO: 5554 - RNA, 738 nt, synthetic construct; identical to SEQ ID NO: 5547
  misc_feature 1..738: note = derived and/or modified CDS sequence (opt4) from SFTSV(2015SYSH33)__KT380653.1__N
  source 1..738: mol_type = other RNA

SEQ ID NO: 5555 - RNA, 738 nt, synthetic construct
  misc_feature 1..738: note = derived and/or modified CDS sequence (opt4) from SFTSV(2015SYSH86)__KT380657.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcatcaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5556 - RNA, 738 nt, synthetic construct
  misc_feature 1..738: note = derived and/or modified CDS sequence (opt4) from SFTSV(67S)__KP339890.1__N
  source 1..738: mol_type = other RNA
atgagcgagtggagcagaatcgccgtggagttcgccgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5557 - RNA, 738 nt, synthetic construct
  misc_feature 1..738: note = derived and/or modified CDS sequence (opt4) from SFTSV(6S)__KP339927.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagattcagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5558 - RNA, 738 nt, synthetic construct
  misc_feature 1..738: note = derived and/or modified CDS sequence (opt4) from SFTSV(72S)__KP339891.1__N
  source 1..738: mol_type = other RNA
atgagcgagtggagcagaatcgccgtggagttcggcgagcagcagctgaccctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgagatggctgaaggccaagggcatcctgggccccgacggcgtgcccagcagagccgccgaggtggccgccgccgcctacagaaacctgtga

SEQ ID NO: 5559 - RNA, 738 nt, synthetic construct
  misc_feature 1..738: note = derived and/or modified CDS sequence (opt4) from SFTSV(AP01-Korea-13)__KR612072.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5560 - RNA, 738 nt, synthetic construct
  misc_feature 1..738: note = derived and/or modified CDS sequence (opt4) from SFTSV(JP03-Korea-13)__KR612079.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcatccccagcagagccgccgaggtggccgccgccgcctacagaaacctgtga

SEQ ID NO: 5561 - RNA, 738 nt, synthetic construct
  misc_feature 1..738: note = derived and/or modified CDS sequence (opt4) from SFTSV(JP07-Korea-13)__KR612088.1__N
  source 1..738: mol_type = other RNA
atgagcgagtggagcagaatcgccgtggagttcggcgagcaccagctgaacctgaccgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5562 - RNA, 738 nt, synthetic construct
  misc_feature 1..738: note = derived and/or modified CDS sequence (opt4) from SFTSV(JS2011-13-2)__KR230790.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcagcagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5563 - RNA, 738 nt, synthetic construct
  misc_feature 1..738: note = derived and/or modified CDS sequence (opt4) from SFTSV(JS2014-15)__KR230799.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgctggtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5564 - RNA, 738 nt, synthetic construct
  misc_feature 1..738: note = derived and/or modified CDS sequence (opt4) from SFTSV(KASJH)__KP663733.1__N
  source 1..738: mol_type = other RNA
atgagcgagtggagcagaatcgccgtggagttcggcgagcagcagctgaacctgagcgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5565 - RNA, 738 nt, synthetic construct
  misc_feature 1..738: note = derived and/or modified CDS sequence (opt4) from SFTSV(YSH116)__KT721303.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgtgttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5566 - RNA, 738 nt, synthetic construct
  misc_feature 1..738: note = derived and/or modified CDS sequence (opt4) from SFTSV(AH-YTY/China/05/2012)__KR017811.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccaccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5567 - RNA, 738 nt, synthetic construct
  misc_feature 1..738: note = derived and/or modified CDS sequence (opt4) from SFTSV(DS02/CHN/2013)__KR698319.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagaaggccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5568 - RNA, 738 nt, synthetic construct
  misc_feature 1..738: note = derived and/or modified CDS sequence (opt4) from SFTSV(HB2014-13)__KU738908.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccaccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgagatggctgaaggccaagggcatcctgggccccgacggcgtgcccagcagagccgccgaggtggccgccgccgcctacagaaacctgtga

SEQ ID NO: 5569 - RNA, 738 nt, synthetic construct
  misc_feature 1..738: note = derived and/or modified CDS sequence (opt4) from SFTSV(HB2014-20)__KU738910.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatgaccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5570 - RNA, 738 nt, synthetic construct
  misc_feature 1..738: note = derived and/or modified CDS sequence (opt4) from SFTSV(LN2012-14)__KF887431.1__N
  source 1..738: mol_type = other RNA
atgagcgagagaagcagaatcgccgtggagttcggcgagcagcagctgaacctgaccggcctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccagaaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5571 - RNA, 738 nt, synthetic construct
  misc_feature 1..738: note = derived and/or modified CDS sequence (opt4) from SFTSV(NB31/CHN/2013)__KR698325.1__N
  source 1..738: mol_type = other RNA
atgagcgagtggagcagaatcgccgtggagttcggcgagcagcagctgaacctgatcgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagaaggccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcaagcccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5572 - RNA, 738 nt, synthetic construct
  misc_feature 1..738: note = derived and/or modified CDS sequence (opt4) from SFTSV(QD7)__KR706565.1__N
  source 1..738: mol_type = other RNA
atgagcgagtggagcagaatcgccgtggagttcggcgtgcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5573 - RNA, 738 nt, synthetic construct
  misc_feature 1..738: note = derived and/or modified CDS sequence (opt4) from SFTSV(SDLZP06/2011)__JQ693009.1__N
  source 1..738: mol_type = other RNA
atgagcgagtggagcagaaccgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5574 - RNA, 738 nt, synthetic construct
  misc_feature 1..738: note = derived and/or modified CDS sequence (opt4) from SFTSV(ZJZHSH-FDE/China/06/2012)__KR017821.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagaaggccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgctgttccccaacgacgtgagagtgaagtggctgaaggccaagggcatcctgggccccgacggcgtgcccagcagagccgccgaggtggccgccgccgcctacagaaacctgtga

SEQ ID NO: 5575 - RNA, 738 nt, synthetic construct
  misc_feature 1..738: note = derived and/or modified CDS sequence (opt4) from SFTSV(ZJZHSH-FZHR/China/07/2013)__KR017824.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactggatgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5576 - RNA, 738 nt, synthetic construct
  misc_feature 1..738: note = derived and/or modified CDS sequence (opt4) from SFTSV(ZJZHSH-HYC/China/05/2012)__KR017809.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagaaggccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgtgggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5577 - RNA, 738 nt, synthetic construct
  misc_feature 1..738: note = derived and/or modified CDS sequence (opt4) from SFTSV(SPL003A)__AB817996.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgcccccagcagagccgccgaggtggccgccgccgcctacagaaacctgtga

SEQ ID NO: 5578 - RNA, 738 nt, synthetic construct
  misc_feature 1..738: note = derived and/or modified CDS sequence (opt4) from SFTSV(SPL077A)__AB985536.1__N
  source 1..738: mol_type = other RNA
atgagcgagtggcccagaatcgccgtggagttcggcgagcagcagctgaacctgaccgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5579 - RNA, 738 nt, synthetic construct
  misc_feature 1..738: note = derived and/or modified CDS sequence (opt4) from SFTSV(SPL106A)__AB985548.1__N
  source 1..738: mol_type = other RNA
atgagcgactggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5580 - RNA, 738 nt, synthetic construct
  misc_feature 1..738: note = derived and/or modified CDS sequence (opt4) from SFTSV(SPL114A)__AB985552.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggcccccggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5581 - RNA, 738 nt, synthetic construct
  misc_feature 1..738: note = derived and/or modified CDS sequence (opt4) from SFTSV(SPL125A)__AB985557.1__N
  source 1..738: mol_type = other RNA
atgagcgagtggagcggcgtggccgtggagttcggcgagcagcagctgaacctgaccgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5582 - RNA, 738 nt, synthetic construct
  misc_feature 1..738: note = derived and/or modified CDS sequence (opt4) from SFTSV(SPL160A)__AB985571.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaccaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5583 - RNA, 738 nt, synthetic construct
  misc_feature 1..738: note = derived and/or modified CDS sequence (opt4) from SFTSV(SPL163A)__AB985573.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgagagacaccaagttcatcatcgtgttccccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5584 - RNA, 738 nt, synthetic construct
  misc_feature 1..738: note = derived and/or modified CDS sequence (opt4) from SFTSV/FTLSV(2011YPQ12)__KF711915.1__N
  source 1..738: mol_type = other RNA
atgagcaagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccaagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcaaggccgccgaggtggccgccgccgcctacagaaacctgtga

SEQ ID NO: 5585 - RNA, 738 nt, synthetic construct
  misc_feature 1..738: note = derived and/or modified CDS sequence (opt4) from SFTSV/FTLSV(2011YXX9)__KF711898.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctggtggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5586 - RNA, 738 nt, synthetic construct
  misc_feature 1..738: note = derived and/or modified CDS sequence (opt4) from SFTSV/FTLSV(YPQ2)__KF356519.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccaacggcgtgcccagcagagccgccgaggtggccgccgccgcctacagaaacctgtga

SEQ ID NO: 5587 - RNA, 738 nt, synthetic construct
  misc_feature 1..738: note = derived and/or modified CDS sequence (opt4) from SFTSV/Guertu virus(DXM)__KT328591.1__N
  source 1..738: mol_type = other RNA
atgagcgagtggagcaagatcgccgtggagttcggcgagcagcagctgaacgtgatcgagctggaggagttcgccagagagctggcctacgagggcctggaccccgccctgatcatcaagaagctgaaggaggtgggcggcgacgactggatgagagacaccaagttcatcatcgtgttcgccctgaccagaggcaacaagatcctgaaggccgccggcaagatgagcaacagcggcagcaagagaatcatggccctgcaggagaagtacggcctggtggagagagccgagaccagactgagcatcacccccgtgagagtggcccagagcctgcccacctggacctgcagcgccgccgccgccctgcaggagtacctgcccgtgggccccgccgtgatgagcctgaaggtgagcaacttcccccccgagatgatgtgcatggccttcggcagcctgatccccgccaccggcgtgcccgagagcaccaccaagatcctgatggaggcctacagcctgtggcaggacgccttcaccaagaccatcaacgtgaagatgagaggcgccagcaaggccgaggtgtacaacagcttcagagaccccctgcacgccgccgtgaacagcgtgttcttccccaacgacgtgagactgagatggctgaagagcaagggcatcctgggccccgacggcctgcccagcaaggccgtggagaccgccgccgccgcctacagaaacctgtga

SEQ ID NO: 5588 - RNA, 738 nt, synthetic construct
  misc_feature 1..738: note = derived and/or modified CDS sequence (opt4) from SFTSV/Huaiyangshan virus(2010-FQM)__HQ419240.1__N
  source 1..738: mol_type = other RNA
atgagcgagtggagcagaatcgccgtgaagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcctgcccaacgacgtgagagtgaagtggctgaaggccaagggcatcctgggccccgacggcgtgcccagcagagccgccgaggtggccgccgccgcctacagaaacctgtga

SEQ ID NO: 5589 - RNA, 738 nt, synthetic construct
  misc_feature 1..738: note = derived and/or modified CDS sequence (opt4) from SFTSV/Huaiyangshan virus(2010-ZGQ)__HQ419241.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatgagcctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccagaaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5590 - RNA, 738 nt, synthetic construct
  misc_feature 1..738: note = derived and/or modified CDS sequence (opt4) from SFTSV/Huaiyangshan virus(S-HGX)__HQ171192.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcaccgccgccgccgccctgaaggagtacctgcccgtgggccccgccgtgatgaacctgaaggtggagaactacccccccgagatgatgtgcatggccttcgagagcctgatccccaccgccggcgtgagcgaggccaccaccaagaccctgatggaggcctacagcctgtggcaggacgccttcaccaagaccatcaacgtggagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5591 - RNA, 738 nt, synthetic construct
  misc_feature 1..738: note = derived and/or modified CDS sequence (opt4) from SFTSV/Huaiyangshan virus(S-HZM)__HQ171193.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccgagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccaccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacctgagagtgaagtggctgaaggccaagggcatcctgggccccgacggcgtgcccagcagagccgccgaggtggccgccgccgcctacagaaacctgtga

SEQ ID NO: 5592 - RNA, 738 nt, synthetic construct
  misc_feature 1..738: note = derived and/or modified CDS sequence (opt4) from SFTSV/Huaiyangshan virus(S-WJ)__HQ171191.1__N
  source 1..738: mol_type = other RNA
atgagcgagtggagcagaatcgccgtggagttcggcgagcagcagctgaacctgaccgagctggaggacttcgccagagagctggcctacgagggcctgggccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5593 - RNA, 738 nt, synthetic construct
  misc_feature 1..738: note = derived and/or modified CDS sequence (opt4) from SFTSV/Phlebovirus(JS2010-019)__JQ317180.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggccgccgccgccgcctacagaaacctgtga

SEQ ID NO: 5594 - RNA, 738 nt, synthetic construct
  misc_feature 1..738: note = derived and/or modified CDS sequence (opt4) from SFTSV/Phlebovirus(SD24/China/2010 strain SD24)__HM802205.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgaccgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5595 - RNA, 738 nt, synthetic construct
  misc_feature 1..738: note = derived and/or modified CDS sequence (opt4) from SFTSV/Phlebovirus(ZJ1/China/2011)__HE663216.1__N
  source 1..738: mol_type = other RNA
atgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgagagacaccaagttcatcatcgtgttcgccctgaccagaggcaacaagatcgtgaaggccagcggcaagatgagcaacagcggcagcaagagactgatggccctgcaggagaagtacggcctggtggagaaggccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaaggccctgatggaggcctacagcctgtggcaggacgccttcaccaagaccatcaacgtgaagatgagaggcgccagcaagaccgaggtgtacagcagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtga

SEQ ID NO: 5596 - RNA, 1287 nt, synthetic construct
  misc_feature 1..1287: note = derived and/or modified CDS sequence (opt3) from ANDV(Chile-9717869)__AF291702.1__N
  source 1..1287: mol_type = other RNA
atgagcaccctgcaggagctccaagaaaacatcacagcccacgagcagcagcttgtgactgctagacagaagctgaaagacgcagaaaaggccgtcgaggttgatcccgacgatgtgaataaatccacgttgcaatctaggcgggcggctgtatcaaccttagaaacaaagctgggcgagctaaaacgccagctcgccgacctggtggcagcccagaaacttgctactaagcctgtcgatccaaccgggctggagccggacgatcatttgaaagaaaagagtagcctccgatacggaaacgtgctggacgttaattccattgatctggaggaaccctctggtcagacagcagactggaaagccataggcgcttatatcctcgggttcgccattcctatcattttaaaggcgctgtacatgctttcgacccgtggaagacaaactgtgaaagataacaagggcacaaggatccggtttaaggacgatagctcattcgaggaggtcaatggtatacgcaaaccaaagcacttgtatgtgagtatgcccaccgcacagtccacgatgaaagccgaagagatcactcctgggagatttaggaccattgcttgcggactgttcccagcccaggtaaaggcacggaacatcatttctcccgttatgggcgtgatcggctttgggttctttgtcaaagactggatggaccgcatagaagagttcctagctgccgaatgtccttttctcccaaagccgaaagtggcgagcgaggccttcatgtccacaaataagatgtactttctgaaccgacagagacaagtgaatgagtcaaaggtccaggatattatcgaccttattgatcatgcagaaactgagagtgctaccctgttcacagaaatcgccacgccccacagcgtttgggtgtttgcttgcgcccctgacaggtgtccacccaccgcattgtatgtagccggagtgcctgagctcggtgctttcttctctatcctgcaggatatgcggaacactattatggcgtccaaatcagtcggcacagcagaagagaagttaaagaagaaaagcgccttttaccaaagttatctgcgtcgcacccagtctatggggatacagctcgaccagaagatcattatcctttacatgctgtcctggggaaaggaggctgtgaatcatttccacttgggcgatgacatggatccagaactaagacaactggcccagagcctcatagacactaaagttaaggagatttcgaaccaggaacccctgaaactttga

SEQ ID NO: 5597 - RNA, 1287 nt, synthetic construct
  misc_feature 1..1287: note = derived and/or modified CDS sequence (opt3) from ANDV(Nort)__AF325966.1__N
  source 1..1287: mol_type = other RNA
atgagcaccctgcaggagctccaagaaaacatcacagcccacgagcagcagcttgtgactgctagacagaagctgaaagacgcagaaaagacggtcgaggttgatcccgacgaagtgaataaatccaccttgcaatctaggcgggccgcggtatcaacattagagactaagctgggcgagctaaaacgccagctcgctgatctggtggccgcacagaaacttgccaccaagcctgtcgacccaacagggctggaaccggatgaccatttgaaggagaagagtagcctccgatacggaaacgtgctggatgttaattccattgacctggaggaaccctctggtcagaccgctgattggaaagcaataggcgcctatatcctcgggttcgctattcctatcattttaaaggccctgtacatgctttcgactcgtggaagacaaacagtgaaagacaacaagggcaccaggatccggtttaaggatgacagctcattcgaggaagtcaatggtatacgcaaaccaaagcacttgtatgtgagtatgcccacggcgcagtccactatgaaagcagaggaaatcacccctgggagatttaggacaattgcctgcggactgttcccagctcaggtaaaggcccggaacatcatttctcccgttatgggcgtgatcggctttagcttctttgtcaaagattggatggagcgcatagaagacttcctagcagctgagtgtccttttctcccaaagccgaaagccctgtccgaggcgttcatggccactaataaggcatactttcttaaccgacagagacaagtgaatgactcaaaggtgcaggatattgtcgacctgatcgatcatgctgaaattgagagtgccaccttgttcacagacatcgctacgccccacagcgtttgggtgtttgcctgcgcacctgataggtgtccacccaccgccctctatgtagctggggtgcctgaactgggagcgttcttcgcaatcttacaggacatgcggaacactattatggcctctaaatccgtcggtacagctgaggaaaagctgaaaaagaaatcagccttttaccaaagctatctccgtcgcacccagtacatgggcatacagcttgatcagaagatcattatcctgtacatgttgagttgggggaaggaggcagtgaatcatttccacctaggagacgatatggacccagagctgagacaactcgcccagtctctgatagatactaaagttaaggaaatttccaaccaggagccccttaaactgtga

SEQ ID NO: 5598 - RNA, 1287 nt, synthetic construct
  misc_feature 1..1287: note = derived and/or modified CDS sequence (opt3) from ANDV(CHI-7913)__AY228237.1__N
  source 1..1287: mol_type = other RNA
atgagcaccctgcaggagctccaagaaaacatcacagcccacgagcagcagcttgtgactgctagacagaagctgaaagacgcagaaaaggccgtcgaggttgatcccgacgatgtgaataaatccacgttgcaaaacaggcgggcggctgtatctaccttagaaacaaagctgggcgagctaaaacgccagctcgccgacctggtggcagcccagaaacttgctactaagcctgtcgatccaaccgggctggagccggacgatcatttgaaagaaaagtcaagtctccgatacggaaatgtgctggacgttaacagcattgatctggaggaaccctccggtcagacagcagactggaaagccataggcgcttatatcctcgggttcgccattcctatcattttaaaggcgctgtacatgctttctacccgtggaagacaagcagtgaaagataataagggcactaggatccggtttaaggacgattcgtcattcgaggaggtcaacggtatacgcaaaccaaagcacttgtatgtgagcatgcccacagcccagagtaccatgaaagctgaagagatcacgcctgggagatttaggactattgcctgcggactgttcccagcacaggtaaaggctcggaatatcatttcccccgttatgggcgtgatcggctttgggttctttgtcaaagactggatggaccgcatagaagagttcctagccgcggaatgtccttttctcccaaagccgaaagtggcctctgaggcattcatgagcaccaacaagatgtactttctgaatcgacagagacaagtgaacgagtccaaggtccaggatattatcgaccttattgatcatgctgaaacagagtcagccactctgttcaccgaaatcgctacaccccacagtgtttgggtgtttgcctgcgcacctgacaggtgtccacccaccgccttgtatgtagctggagtgcctgagctcggtgcgttcttcagcatcctgcaggatatgcggaatacgattatggcatctaaatccgtcggcactgccgaagagaagttaaagaagaaatcagctttttaccaaagctatctgcgtcgcacacagagtatggggatacagctcgaccagaagatcattatcctttacatgctgtcttggggaaaggaggccgtgaaccatttccacttgggcgatgacatggatccagaactaagacaactggcacagtccctcatagacaccaaagttaaggagattagcaatcaggaacccctgaaactttga

SEQ ID NO: 5599 - RNA, 1287 nt, synthetic construct
  misc_feature 1..1287: note = derived and/or modified CDS sequence (opt3) from ANDV(9718133)__AF482712.1__N
  source 1..1287: mol_type = other RNA
atgagcaccctgcaggagctccaagaaaacatcacagcccacgagcagcagcttgtgactgctagacagaagctgaaagacgcagaaaaggccgtcgaggttgatcccgacgatgtgaataaatccacgttgcaaaacaggcgggcggctgtatctaccttagaaacaaagctgggcgagctaaaacgccagctcgccgacctggtggcagcccagaaacttgctactaagcctgtcgatccaaccgggctggagccggacgatcatttgaaagaaaagtcaagtctccgatacggaaatgtgctggacgttaacagcattgatctggaggaaccctccggtcagacagcagactggaaagccataggcgcttatatcctcgggttcgccattcctatcattttaaaggcgctgtacatgctttctacccgtggaagacaaactgtgaaagataataagggcacaaggatccggtttaaggacgattcgtcattcgaggaggtcaacggtatacgcaaaccaaagcacttgtatgtgagcatgcccaccgcacagagtacgatgaaagccgaagagatcactcctgggagatttaggaccattgcttgcggactgttcccagcccaggtaaaggcacggaatatcatttcccccgttatgggcgtgatcggctttgggttctttgtcaaagactggatggaccgcatagaagagttcctagctgccgaatgtccttttctcccaaagccgaaagtggcgtctgaggccttcatgagcacaaacaagatgtactttctgaatcgacagagacaagtgaacgagtccaaggtccaggatattatcgaccttattgatcatgcagaaactgagtcagctaccctgttcacagaaatcgccacgccccacagtgtttgggtgtttgcttgcgcccctgacaggtgtccacccaccgcattgtatgtagccggagtgcctgagctcggtgctttcttcagcatcctgcaggatatgcggaatactattatggcgtctaaatccgtcggcacagcagaagagaagttaaagaagaaatcagccttttaccaaagctatctgcgtcgcacccagagtatggggatacagctcgaccagaagatcattatcctttacatgctgtcttggggaaaggaggctgtgaaccatttccacttgggcgatgacatggatccagaactaagacaactggcccagtccctcatagacactaaagttaaggagattagcaatcaggaacccctgaaactttga

SEQ ID NO: 5600 - RNA, 1278 nt, synthetic construct
  misc_feature 1..1278: note = derived and/or modified CDS sequence (opt3) from Araraquara virus(9480)__KP202360.1__N
  source 1..1278: mol_type = other RNA
atgagcaacctgcaggagctccaagaaaatatcaccgcccacgagcagcagcttgtgacagctagacagaagctgaaagacgcagaaaaggccgtcgatgttgaccccgatgaggtgaacaaatccactttgcaaggcaggcgggcggctgtatctacgttagaaaccaagctgggggagctaaaacgccagctcgccgacctggtggcagcccagcgacttgcttcaaagcctgtcgatccaacaggaattgagccggacgatcatctgaaggagaaaagtagcttgcgttacggtaatgtgctcgacgttaactccatagatctggaagaaccctctggccagactgcagactggaaggccatcggggcttatattctgggattcgccatccctattatcctcaaagcgttatacatgctgtcgaccagaggcaggcaaacagtgaaggataataaaggtacccggatacgctttaaggacgatagctcattcgaggaggtcaacgggatcagaaagccaaaacacctttatattagtatgcccactgcacagtccacaatgaaggccgaagagatcacccctggaaggtttcggacgattgcttgcggcttgttcccagcccaggtgaaagcacgcaatatcatatctcccgtaatgggcgttattgggtttgctttctttgtgaaggactggatggaacgaatcgaggacttcctggccagcgaatgtccttttctaccaaaaccgaagaacccctccgaggcgttcatggccactaataaagcatactttctcaacagacagaagcaagtcgatgagtcacaggtgcctgacattgtggatctgatcgaccatgctgaagccgagagtgctacccttttcaaggaaatcgccagcccacactctgtctgggtttttgcatgcgcccccgataggtgtcctccaacagctctgtatgtggcgggaatgcccgagttgggtgcattcttcgccattctccaggacatgcggaatactataatggcttccaaatcagtaggcaccgccgaagagaagctgaaaaagaaaagcgcattttaccaaagttatttacgtcgcacacagtctatggggatccagctggatcagaagattatcatactctacatgctttcctggggaaaggaggccgtgaaccatttccacctgggcgacgatatggacccggaattgagacaactagctcagagcctgattgataccaaagtcaaggagtcgcagacgaaatctctctga

SEQ ID NO: 5601 - RNA, 1287 nt, synthetic construct
  misc_feature 1..1287: note = derived and/or modified CDS sequence (opt3) from Araraquara-like virus(P5/Cajuru)__EF571895.1__N
  source 1..1287: mol_type = other RNA
atgagcaacctgcaggagctccaagaaaatatcaccgcccacgagcagcagcttgtgacagctagacagaagctgaaagacgcagaaaaggccgtcgatgttgaccccgatgaggtgaacaaatccactttgcaaggcaggcgggcggctgtatctacgttagaaaccaagctgggggagctaaaacgccagctcgccgacctggtggcagcccagcgacttgcttcaaagcctgtcgatccaacaggaattgagccggacgatcatctgaaggagaaaagtagcttgcgttacggtaatgtgctcgacgttaaccccatagatctggaagaaccttccggccagactgcagactggaaggccatcggggcttatattctgggattcgccatcccaattatcctcaaagcgttatacatgctgtctaccagaggcaggcaaacagtgaaggataataaaggtacccggatacgctttaaggacgattcgtcattcgaggaggtcaacgggatcagaaagcccaaacacctttatattagcatgcctactgcacagagtacaatgaaggccgaagagatcaccccaggaaggtttcggacgattgcttgcggcttgttccccgcccaggtgaaagcacgcaatatcatatcccctgtaatgggcgttattgggtttggattctttgtgaaggactggatggaacgaatcgaggacttcctggcttctgaatgtccatttctaccgaaacccaagaaccctagcgaggccttcatggcgactaataaagcctactttctcaacagacagaagcaagtcgatgagtcccaggtgccagacattgtggatctgatcgaccatgcagaagctgagtcagccacccttttcaaggaaatcgctagtccccacagcgtctgggtttttgcctgcgcacctgataggtgtccacccacagccctgtatgtggctggtttgccggagctcggcgcgttcttcgcaattctgcaggacatgcggaatactataatggcctctaaatccgtagggaccgctgaagagaagctgaaaaagaaatcagccttttaccaaagctatttacgtcgcacacagagtatgggaatccagctcgatcagaagattatcatactttacatgctgtcttggggcaaggaggcagtgaaccatttccacttgggtgacgatatggaccctgaactaagacaactggcccagtccctcattgataccaaagtcaaggagatcagcaatcaggggcccctgaaactttga

SEQ ID NO: 5602 - RNA, 1287 nt, synthetic construct
  misc_feature 1..1287: note = derived and/or modified CDS sequence (opt3) from BMJV(Oc22531)__AF482713.1__N
  source 1..1287: mol_type = other RNA
atgagcaccctgcaggagctccaagaaaacatcacagcccacgagcagcagcttgtgactgctagacagaagctgaaggacgcagaaaagacggtcgaggttgatcccgacgaagtgaataaatccaccttgcaatctaggcgggccgcggtatcaacattagagactaagctgggcgagctaaaacgccagctcgctgatctggtggccgcacagaaacttgccaccaagcctgtcgacccaacagggctggaaccggatgaccatttgaaggagaagagtagcctccgatacggaaacgtgctggatgttaattccattgacctggaggaaccctctggtcagaccgctgattggcgttcgataggcgcatatatcctcgggttcgccattcctatcattttaaaagctctgtacatgctttcaactagaggaaggcaaacagtgaaggacaacaaaggcacccggatccgctttaaggatgacagcagtttcgaggaagtcaatggtataagaaagccaaaacacttgtatgtgtccatgcccacggcccagtctactatgaaggcggaggaaatcacccctgggaggtttcggacaattgcatgcggactgttcccagcccaggtaaaagctcgcaacatcattagccccgttatgggcgtgatcggcttttccttctttgtcaaggattggatggagcgaatagaagacttcctagccgcagagtgtccttttctcccaaaaccgaaggctccctcagaggccttcatggcgactaataaagcctactttctgaacagacagaggcaagtgaatgaaagtaaggtgcaggacattgtcgatcttatcgaccatgcagagaccgaaagcgctacactgttcaccgatattgccacgcctcactctgtttgggtgtttgcttgcgccccagaccggtgtccccctactgcattgtatgtagccggggtgccagagctcggagctttcttcgcgatcctgcaggatatgcgtaacacaatcatggcatccaagtcagtcggtaccgccgaagagaaattaaagaaaaagagcgctttttaccaaagttatctgcgcagaactcagtctatgggcattcagctcgaccagaaaataatcattctttacatgctgtcctgggggaaggaggccgtgaatcatttccacttgggagatgacatggatcccgaactaaggcaactggcacagagcctcatcgacacaaaggttaaagagatatcgaaccaggaaccgctgaaactttga

SEQ ID NO: 5603 - RNA, 1287 nt, synthetic construct
  misc_feature 1..1287: note = derived and/or modified CDS sequence (opt3) from LECV(22819)__AF482714.1__N
  source 1..1287: mol_type = other RNA
atgagcaccctgcaggagctccaagaaaacatcacagcccacgagcagcagcttgtgactgctagacagaagctgaaggacgcagaaaagacggtcgaggttgatcccgacgaagtgaataaatccaccttgcaatctaggcgggccgcggtatcaacattagagactaagctgggcgagctaaaacgccagctcgctgatctggtggccgcacagaaacttgccaccaagcctgtcgacccaacagggctggaaccggatgaccatttgaaggagaagagtagcctccgatacggaaacgtgctggatgttaattccattgacctggaggaaccctctggtcagaccgctgattggcgttcgataggcgcatatatcctcgggttcgccattcctatcattttaaaagctctgtacatgctttcaactagaggaaggcaaacagtgaaggacaacaaaggcacccggatccgctttaaggatgacagcagtttcgaggaagtcaatggtataagaaagccaaaacacttgtatgtgtccatgcccacggcccagtctactatgaaggcggaggaaatcacccctgggaggtttcggacaattgcatgcggactgttcccagcccaggtaaaagctcgcaacatcattagccccgttatgggcgtgatcggcttttccttctttgtcaaggattggatggagcgaatagaagacttcctagccgcagagtgtccttttctcccaaaaccgaaggctccctcagaggccttcatggcgactaataaagcctactttctgaacagacagaggcaagtgaatgaaagtaaggtgcaggagattgtcgaccttatcgatcatgcagaaaccgagagcgctacactgttcaccgacattgccacgcctcactctgtttgggtgtttgcttgcgccccagatcggtgtccccctactgcattgtatgtagccggggtgccagaactcggagctttcttcgcgatcctgcaggacatgcgtaacacaatcatggcatccaagtcagtcggtaccgccgaggagaaattaaagaaaaagagcgctttttaccaaagttatctgcgcagaactcagtctatgggcattcagctcgatcagaaaataatcattctttacatgctgtcctgggggaaggaagccgtgaatcatttccacttgggagacgatatggaccccgagctaaggcaactggcacagagcctcatcgatacaaaggttaaagaaatatcgaaccaggagccgctgaaactttga

SEQ ID NO: 5604 - RNA, 1287 nt, synthetic construct
  misc_feature 1..1287: note = derived and/or modified CDS sequence (opt3) from MCLV(13796)__AF482716.1__N
  source 1..1287: mol_type = other RNA
atgagcaacctgcaggagctccaagaaaatatcaccgcccacgagcagcagcttgtgacagctagacagaagctgaaagacgcagaaaaggccgtcgatgttgaccccgatgaggtgaacaaatccactttgcaaggcaggcgggcggctgtatctacgttagaaaccaagctgggggagctaaaacgccagctcgccgacctggtggcagcccagaaacttgctacaaagcctgtcgatccaactggaattgagccggacgatcatctgaaagaaaagtcaagtttgcgatacggtaatgtgctcgacgttaacagcatagatctggaggaaccctccggccagaccgcagactggaaagccatcggggcttatattctgggattcgccatccctattatcctcaaggcgttatacatgctgtctacacgtggcagacaaaccgtgaaagataataagggtactaggatacggtttaaggacgattcgtcattcgaggaggtcaacgggatccgcaaaccaaagcacctttatattagcatgcccacagcacagagtaccatgaaagccgaagagatcacgcctggaagatttaggactattgtgtgcggcttgttcccagctcaggtaaaggcccggaatatcatatcccccgttatgggcgtgattgggttttctttctttgtcaaagactggatggaacgcatcgagggattcctggcagctgaatgtccttttctaccaaagccgaaaaccgccgcggagacattcatggccactaacaaggcatactttttcaatcgacagagacaagtggacgagagccaggtgcccgatattgtcgaactcatcgaccaggctgagtccgaatcagccaccctgtttacagagatcgctagtcctcatagcgtttgggtgttcgcctgcgcaccagataggtgtccccctaccgccctttatgtagctggtgtgccagaactgggcgcgttctttgcaattttgcaagacatgcggaacacgataatggcctctaagtccgtcgggactgctgaggagaaactcaagaaaaagtcagccttctaccagagctatctgcgtcgcacacagagtatgggaatccagttagatcaaaagattatcatactgtacatgctctcttggggcaaggaagcagtgaatcactttcatcttggtgacgatatggaccccgagctgagacagttggcccaggctctaattgataccaaggttaaagaaatctccaaccaggagccgctgaagctctga

SEQ ID NO: 5605 - RNA, 1287 nt, synthetic construct
  misc_feature 1..1287: note = derived and/or modified CDS sequence (opt3) from Neembucu(Neembucu)__DQ345763.1__N
  source 1..1287: mol_type = other RNA
atgagcaccctgcaggagctccaagaaaacatcacagcccacgagcagcagcttgtgactgctagacagaagctgaaagacgcagaaaagacggtcgaggttgatcccgacgaagtgaataaatccaccttgcaatctaggcgggccgcggtatcaacattagagactaagctgggcgagctaaaacgccagctcgctgatctggtggccgcacagaaacttgccacccgacctgtcgacccaacagggctggaaccggatgaccatttgaaggagaagagtagcctccgttacggaaacgtgctggatgttaattccattgacctggaggaaccctctggtcagaccgctgattggagatcgataggcgcatatatcctcgggttcgccattcctatcattttaaaggctctgtacatgctttcaactaggggacggcaaacagtgaaagacaacaagggcacccgcatcagatttaaagatgacagcagtttcgaggaagtcaatggtataaggaagccaaagcacttgtatgtgtccatgcccacggcccagtctactatgaaagcggaggaaatcacccctgggcggctgcgcacaattgcatgcggactatttccagcccaggtaaaggctcgaagcatcatttcccccgttatgggcgtgatcggcttctcatttttcgtcaaagattggatggagagaatagaagactttctcgccgcagagtgtcctttcctgccaaagccgaaagctcccagtgaggcctttatggcgactaacaaggcctacttccttaataggcagcggcaagtgaacgaaagcaaagtgcaggacattgtcgatctgatcgaccatgcagagaccgaatctgctacattgtttaccgatattgccacgcctcactccgtttgggtgttcgcttgcgccccagaccgttgtccccctactgcactctatgtagccggggtgccagagctgggagcgtttttcgctatcttacaggatatgcgcaatacaatcatggcatcaaagagcgtcggtaccgccgaagagaagctgaaaaagaaaagtgctttctaccaatcttatctcagaaggactcagtccatgggcattcagcttgaccagaagataatcattctgtacatgttgagctgggggaaagaggccgtgaaccattttcacctaggagatgacatggatcccgaactgcggcaactcgcacagtcgctgatcgacacaaaggttaaggagatatctaatcaggaaccgcttaaactgtga

SEQ ID NO: 5606 - RNA, 1287 nt, synthetic construct
  misc_feature 1..1287: note = derived and/or modified CDS sequence (opt3) from ORNV(22996)__AF482715.1__N
  source 1..1287: mol_type = other RNA
atgagcaccctgcaggagctccaagaaaacatcacagcccacgagcagcagcttgtgactgctagacagaagctgaaagacgcagaaaagacggtcgaggttgatcccgacgaagtgaataaatccaccttgcaatctaggcgggccgcggtatcaacattagagactaagctgggcgagctaaaacgccagctcgctgatctggtggccgcacagaaacttgccaccaagcctgtcgacccaacagggctggaaccggatgaccatttgaaggagaagagtagcctccgatacggaaacgtgctggatgttaattccattgacctggaggaaccctctggtcagaccgctgattggaaagcaataggcgcctatatcctcgggttcgctattcctatcattttaaaggccctgtacatgctttcgactcgtggaagacaaacagtgaaagacaacaagggcaccaggatccggtttaaggatgacagctcattcgaggaagtcaatggtatacgcaaaccaaagcacttgtatgtgagtatgcccacggcgcagtccactatgaaagcagaggaaatcacccctgggagatttaggacaattgcctgcggactgttcccagctcaggtaaaggcccggaacatcatttctcccgttatgggcgtgatcggctttagcttctttgtcaaagattggatggagcgcatagaagacttcctagcagctgagtgtccttttctcccaaagccgaaagccctgtccgaggcgttcatggccactaataaggcatactttcttaaccgacagagacaagtgaatgactcaaaggtgcaggatattgtcgacctgatcgatcatgctgaaattgagagtgccaccttgttcacagacatcgctacgccccacagcgtttgggtgtttgcctgcgcacctgataggtgtccacccaccgccctctatgtagctggggtgcctgaactgggagcgttcttcgcaatcttacaggacatgcggaacactattatggcctctaaatccgtcggtacagctgaggaaaagctgaaaaagaaatcagccttttaccaaagctatctccgtcgcacccagagtatgggcatacagcttgatcagaagatcattatcctgtacatgttgtcttgggggaaggaggcagtgaatcatttccacctaggagacgatatggacccagagctgagacaactcgcccagtccctgatagatactaaagttaaggaaattagcaaccaggagccccttaaactgtga

SEQ ID NO: 5607 - RNA, 1287 nt, synthetic construct
  misc_feature 1..1287: note = derived and/or modified CDS sequence (opt3) from PRGV(14403)__AF482717.1__N
  source 1..1287: mol_type = other RNA
atgagcaccctgcaggagctccaagaaaacatcacagcccacgagcagcatcttgtgactgctagacagaagctgaaggacgcagaaaagacggtcgaggttgatcccgacgaagtgaataaatccaccttgcagtctaggcgggccgcggtatcaacattagagactaagctgggcgagctaaaacgccaactcgctgatctggtggccgcacagaaacttgccgctaagcctgtcgacccaaccgggctggaaccggatgaccacttgaaggagaagagtagcctccgatacggaaacgtgctggatgttaattccattgacctggaggaaccctctggtcagacagcagattggaaagccataggcgcttatatcctcgggttcgccattcctatcattttaaaggcgctgtacatgctttcgacccgtggaagacagactgtgaaagacaacaagggcacaaggatccggtttaaggatgacagctcattcgaggaagtcaatggtatacgcaaaccaaagcatttgtatgtgagtatgcccaccgcacaatccacgatgaaagccgaggaaatcactcctgggagatttaggaccattgcttgcggactgttcccagcccaggtaaaggcacggaacatcatttctcccgttatgggcgtgatcggctttagcttctttgtcaaagattggatggagcgcatagaagacttcctagctgccgagtgtccttttctcccaaagccgaaaacaacttccgaggcgttcatgtcaaccaataaggcctactttctgaaccgacagagacaggtggacgaaagtcaagtgcccgatattgcagagcttatcgaacaggctgagagcgaatctgccacactgttcaccgagattgcttcccctcactcagtctgggtttttgcctgcgcaccagacaggtgtccccctacggccttgtatgtggctggggtaccagagctcggagcgttcttcgcaatcctgcaggatatgcggaatactatcatggccagcaagagtgtgggtacagctgaagagaaattaaagaaaaagtctgccttttaccaatcctatctgcgtcgcacccagagcatgggcattcagctcgaccagaaaataatcattctttacatgctgtcgtgggggaaggaagcagtcaaccatttccacttgggagatgacatggatcccgagctaagacaactggcccaggctctcatcgacactaaggtgaaagaaatatctaatcaggagccgctgaaactttga

SEQ ID NO: 5608 - RNA, 1287 nt, synthetic construct
  misc_feature 1..1287: note = derived and/or modified CDS sequence (opt3) from TUNV(FVB554)__JF750419.1__N
  source 1..1287: mol_type = other RNA
atgagcaacctgcaggagctccaagaaaatatcaccgcccacgagcagcagcttgtgacagctagacagaagctgaaagacgcagaaaaggccgtcgagatggatcccgacgatgttaacaaatccactttgcaatctaggcgggcggctgtgtcaacgttagaaaccaagctgggcgagctaaaacgccagctcgccgacatggtagcagcccagaagctggctacaaagcctgtggatccaactgggcttgagccggacgatcatctgaaagaaaagagtagcttgcgatacggaaatgtcctcgacgtgaactccattgatctggaggaaccctctggtcagaccgcagactggaaatcgataggcgcctatatcctggggttcgctattcctatcattctcaaggccttatacatgctgtcaacacgtggaagacaaaccgttaaagataataagggcactaggatccggtttaaggacgatagcagtttcgaggaggtgaacggtatacgcaaaccaaagcacctttatgtctccatgcccacagcgcagtctaccatgaaagcagaagagatcacgcctgggagatttaggactattgcctgcggattgttcccagctcaggtgaaggcccggaatatcattagccccgtaatgggcgttatcggcttttccttctttgtgaaagactggatggaacgcatagaggacttcctggcagatgaatgtccttttctaccaaagccgaaatcacccagtgaggctttcatggccaccaacaaggcgtactttctcaatcgacagagacaagtcaacgacagcaaggtgcaggatattgtggacctgatcgatcatgccgagacagaatctgcaactcttttcaccgacattgctacacctcactccgtctgggtttttgcctgcgctccagataggtgtccccctaccgccctgtatgtggcaggggtaccagagttgggagccttcttcgctatcctccaggacatgcggaatacgatcatggcgtcaaaaagcgtgggtactgcagaagagaagctgaaaaagaaaagtgccttttaccaatcttatttacgtcgcacacagtccatgggcattcagctggatcagaagataatcattctctacatgcttagctgggggaaggaagctgtcaaccatttccacctgggagacgatatggaccccgagttgagacaactagcccaggcactgatcgacaccaaagtgaaggagatatcgaatcaggaaccgctcaaactgtga

SEQ ID NO: 5609 - RNA, 1287 nt, synthetic construct
  misc_feature 1..1287: note = derived and/or modified CDS sequence (opt3) from BCCV(BCCV)__AB689163.1__N
  source 1..1287: mol_type = other RNA
atgagcaacctgaaggaggtgcaggacaatatcaccacacacgaacaacagctcgtcgccgctagacagaaacttaaggatgcagagaggactgttggcgtggaccccgatgacgtaaacaaatccacgctgcagaatcggcgcgccgcggtgtctgctttggaagccaagattggggagttaaaacgacaactggcagatctagtcgccgctcagaagctcgcaaccaagtcagtggaccctacaggaatagaaccagatgaccatctgaaagagaagagtagccttcgttacggtaacgttctggatgtcaattccatcgacttggaggaaccgtctggccagactgccgattggaaagctattgggacctatatcctctcgttcgtgctgcccattgtgctgaaggccctctacatgttatcaacaagaggaaggcagaccgtaaaagagaacaagggcactcggatccgctttaaggacgatagcagttatgaagacgttaatggtataagaaaacctaagcacctgtacgtgtcccttccaacagcgcaatctaccatgaaagcagacgagatcacgcccgggaggttccggactattgtctgcggattgtttcctgcccagatcaaggctcgcaacattatcagcccagtgatgggcgtgataggcttctcctttttcgtcaaagattgggttgacaagattgaggattttctgcgagccgaatgtcccttcctacctaaaccaagagcacaggctgagtcatttctcagtaccaatggggcctatttcatgaacaggcagacacaagtggaagagagcaaggtacaggacatcctggatcttattgacactgcggaatctggaggtgccaccctgtttgataatatcgcatccccgcagtcagcttggatcttcgcctgcgctcccgaccggtgtcctccaacagccttgtacgtggcaggcgtccccgagctcggggcctttttcagcattctgcaagatatgcgtaacaccataatggctagtaagtctgtgggaacggcggaggaaaaattaaagaaaaagtccgcattctatcagagctacctgcgcagaactcagtcgatgggcatccagctcgaccagaaaattatcatactttacatgattaattggggtaaggaggccgttaaccattttcacctgggggatgacatggaccctgaattgaggcaactagctcaggccctggtggatacaaaggtcaaagagatctctaatcaggaaccactcaagatctga

SEQ ID NO: 5610 - RNA, 1287 nt, synthetic construct
  misc_feature 1..1287: note = derived and/or modified CDS sequence (opt3) from BCCV(BCCV)__L39949.1__N
  source 1..1287: mol_type = other RNA
atgagcaacctgaaggaggtgcaggacaatatcaccacacacgaacaacagctcgtcgccgctagacagaaacttaaggatgcagagaggactgttgaagtggaccccgatgacgtaaacaaatccacgctgcagaatcggcgcgccgcggtgtctgctttggaggccaagattggcgaattaaaacgacaactggcagatctagtcgccgctcagaagctcgcaaccaagtcagtggaccctacagggatagagccagatgaccatctgaaagagaagagtagccttcgttacggaaacgttctggatgtcaattccatcgacttggaggaaccgtctggtcagactgccgattggaaagctattggcacctatatcctctcgttcgtgctgcccattgtgctgaaggccctctacatgttatcaacaagagggaggcagaccgtaaaagaaaacaagggaactcggatccgctttaaggacgatagcagttatgaggacgttaatggcataagaaaacctaagcacctgtacgtgtcccttccaacagcgcaatctaccatgaaagcagacgagatcacgcccggtaggttccggactattgtctgcgggttgtttcctgcccagatcaaggctcgcaacattatcagcccagtgatgggagtgataggcttctcctttttcgtcaaagattgggttgacaagattgaagattttctgcgagccgagtgtcccttcctacctaaaccaagagcacaggctgaatcatttctcagtaccaatggcgcctatttcatgaacaggcagacacaagtggaggaaagcaaggtacaggacatcctggatcttattgacactgcggagtctgggggagccaccctgtttgataatatcgcatccccgcagtcagcttggatcttcgcctgcgctcccgaccggtgtcctccaacagccttgtacgtggccggtgtccccgagctcggcgcatttttcagcattctgcaagatatgcgtaacaccataatggctagtaagtctgtggggacggcggaagagaaattaaagaaaaagtccgcattctatcagagctacctgcgcagaactcagtcgatgggaatccagctcgaccagaaaattatcatactttacatgattaattggggcaaggaagccgttaaccattttcacctgggtgatgacatggaccctgagttgaggcaactagctcaggccctggtggatacaaaggtcaaagaaatctctaatcaggagccactcaagatctga

SEQ ID NO: 5611 - RNA, 1290 nt, synthetic construct
  misc_feature 1..1290: note = derived and/or modified CDS sequence (opt3) from DOBV(DOBV/Ano-Poroia/Afl9/1999)__NC_005233.1__N
  source 1..1290: mol_type = other RNA
atggccaccctggaggaactccagaaggagatcaacaatcacgaaggccaacttgtgattgctagacagaaagtcaaggacgcagagaaacagtacgaaaaggatcccgacgatctgaacaaaagggccttgagcgaccgggagtccatagcgcagtctatccaagggaagattgatgagttacgccgacagctggctgaccgtgttgccgcaggaaagaatatcggtaaagaaagagatcctacaggcctagacccaggggatcatctcaaggagaaatcaatgctgagttatggaaacgtgattgaccttaatcacctggatatcgacgaaccgactggccagacggccgattggttgagcatagtagtgtacctcacctccttcgtcgtgcccatcctgctgaaggctctctatatgttaacaactaggggtcggcagaccacaaaagacaacaaggggatgcgcattagatttaaggacgattcttcgttcgaggacgttaatggaatcaggaaacctaagcatctgtttctttcaatgccaaacgcacaaagcagtatgaaagccgatgagattacccccggccggttccgcactgctatctgcggcttgtaccctgcccaggtgaaggcgcgaaatctgatatccccagtcatgtctgtgattgggtttctagcactcgccaaaaactggacagaaagagtagaggaatggctggaccttccctgtaagctgttgagcgagccttccccaacctcactcacgaaaggaccgagtactaatagggattatctgaaccagcggcagggtgctttagccaagatggaaaccaaggaggcacaagctgttcgtaaacacgccatcgacgcgggctgcaatctgattgatcatatcgacagcccctcttccatctgggtgttcgccggggcacctgatcgctgtccacccacatgcctctttattgctggaatggccgagcttggcgctttctttgccgtcctgcaggacatgagaaacactataatggcatcaaagaccatcggtacaagcgaagagaaattgaagaaaaagagttctttctaccagtcctatctaaggcggacccaaagcatggggattcagctggatcagcgaatcatagtgctctttatggtggactggggaaaggaagccgtcgactcgttccacctgggcgatgacatggatcctgagcttcgcggcctggctcaggcgttgattgaccaaaaagttaaggaaatctctaatcaggagccactcaaactgtga

SEQ ID NO: 5612 - RNA, 1290 nt, synthetic construct
  misc_feature 1..1290: note = derived and/or modified CDS sequence (opt3) from DOBV(DOB/Saaremaa/160V)__AJ009773.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctatagcgcagtcaatccaagggaagattgatgagttacgccgacagctggctgaccgtgttgccgcaggaaagaacatcggtaaagaaagagatcctacaggcctagacccaggggatcatctcaaggagaaaagtatgctgagctatggaaatgtgattgaccttaaccacctggatatcgacgaaccgactggccagacggccgattggttgtccatagtaatctacctcacctctttcgtggtccccattctgctgaaggctctctatatgttaacaactaggggtcggcagaccacaaaagacaataaggggatgcgcatcagatttaaggacgattcgtcattcgaggacgtgaacggaattaggaaacctaagcatctgtttcttagcatgccaaatgcacaaagttccatgaaagccgatgagatcacccccggccggttccgcactgctgtttgcggcttgtaccctgcccaggtgaaggcgcgaaacctgatatctccagtcatgagcgtgattgggtttctaacactcgccaaaaattggaccgaaagagtagaggaatggctggaccttccctgtaagctgttgtccgagccttcaccaacgagtctcactaaaggaccgagcaccaacagggattatctgtctcagcggcagggtgcattagctaagatggaaacaaaggaggcccaagttgtgcgtaaacacgcaatcgacgctggctgcaatattatcgatcatatcgactccccctcaagcatttgggtcttcgccggggcgcctgatcgctgtccacccacttgcctgtttatagccggaatggcagagctcggcgctttctttgccgtgcttcaggacatgagaaacaccatcatggctagtaagacaattggtacctctgaagagaaactgaggaagaaatccagcttctaccagtcgtatttgcggcgaacgcaatctatggggatccagctagatcagcgcataattgtgctgtttatgatcgaatggggaaaggaggccgtcgactccttccacctcggcgacgatatggaccctgaaatcagatcactggcacaggcccttattgatcaaaaggttaaagagatcagtaatcaggagccactgaagttgtga

SEQ ID NO: 5613 - RNA, 1290 nt, synthetic construct
  misc_feature 1..1290: note = derived and/or modified CDS sequence (opt3) from DOBV(Slovakia/400Af/98)__AY168576.1__N
  source 1..1290: mol_type = other RNA
atggccaccctggaggaactccagaaggagatcaacaatcacgaaggccaacttgtgattgctagacagaaagtcaaggacgcagagaaacagtacgaaaaggatcccgacgatctgaacaaaagggccttgagcgaccgggagtccatagcgcagtctatccaagggaagattgatgagttacgccgacagctggctgaccgtgttgccgcaggaaagaatatcggtaaagaaagagatcctacaggcctagacccaggggatcatctcaaggagaaatcaatgctgagttatggaaacgtgattgaccttaatcacctggatatcgacgaaccgactggccagacggccgattggttgagcatagtagtgtacctcacctccttcgtcgtgcccatcctgctgaaggctctctatatgttaacaactaggggtcggcagaccacaaaagacaacaaggggatgcgcattagatttaaggacgattcttcgttcgaggacgttaatggaatcaggaaacctaagcatctgtttctttcaatgccaaacgcacaaagcagtatgaaagccgatgagattacccccggccggttccgcactgctatctgcggcttgtaccctgcccaggtgaaggcgcgaaatctgatatccccagtcatgtctgtgattgggtttctagcactcgccaaaaactggacagaaagagtagaggaatggctggaccttccctgtaagctgttgagcgagccttccccaacctcactcacgaaaggaccgagtactaatagggattatctgaaccagcggcagggtgctttagccaagatggaaaccaaggaggcacaagctgttcgtaaacacgccatcgacgcgggctgcaatctgattgatcatatcgacagcccctcttccatctgggtgttcgccggggcacctgatcgctgtccacccacatgcctctttattgctggaatggccgagcttggcgctttctttgccgtcctgcaggacatgagaaacactataatggcatcaaagaccatcggtacaagcgaagagaaattgaagaaaaagagttctttctaccagtccctactgaggcggacccaaagcatggggattcagctcgatcagcgaatcatagtgctgtttatggtggactggggaaaggaagccgtcgactcgttccaccttggcgatgacatggatcctgagctgcgcggcttggctcaggcgctcattgaccaaaaagttaaggaaatctctaatcaggagccactgaaattatga

SEQ ID NO: 5614 - RNA, 1290 nt, synthetic construct
  misc_feature 1..1290: note = derived and/or modified CDS sequence (opt3) from DOBV(Slovakia-856-Aa)__AJ269549.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaaagtaagatcgatgagttacgccgacagctggctgaccgtgtggccgcagggaagaacattggaaaagaaagagatcctacaggtctagacccaggcgatcatctcaaggagaaaagcatgctgtcctatgggaatgtaatcgaccttaaccacctggatattgacgaaccgactggacagacggccgattggttgtctatcgtggtctacctcacctcgttcgtggttcccatactgctgaaggctctctatatgttaacaactaggggccggcagaccacaaaagacaataagggtatgcgcatcagatttaaggacgatagctcattcgaggacgtgaacgggattaggaaacctaagcatctgtttcttagtatgccaaatgcacaatcctctatgaaagccgatgagatcacccccggacggttccgcactgctatttgcggcttgtaccctgcccaggtcaaggcgcgaaacctggtgagcccagtaatgtccgttatcggctttatggcactagccaaaaattggacagaaagagtggaggaatggctcgacctgccctgtaaacttctgtcagagcctagtccaaccagcttgacgaaggggccgtctactaacagggattatctcaatcagcggcagggagctctggccaagatggaaaccaaggaggcacaagctgtccgtaaacacgccatagacgcgggttgcaacattatcgatcatattgactccccctcaagcatctgggtgttcgcccctgcaccagatcgctgtccccctacatgcttatttatcgctggcatggccgagctgggggctttctttagtgtgctccaggacatgagaaatactattatggcctctaagaccataggaacatccgaagagaaacttaggaagaaaagctcgttctaccagtcttatctgcggcgaacccaatccatgggcatccagttggatcagcgcattatcgtcctatttatggttgactggggtaaggaagcagtggactcattccacctgggggatgacatggatccagagctcagaggactggcccaggctcttatagaccaaaaggtaaaagaaattagtaaccaggagcccctgaagttgtga

SEQ ID NO: 5615 - RNA, 1290 nt, synthetic construct
  misc_feature 1..1290: note = derived and/or modified CDS sequence (opt3) from DOBV(Slovakia-862-Aa)__AJ269550.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaaagtaagatcgatgagttacgccgacagctggctgaccgtgtggccgcagggaagaacattggaaaagaaagagatcctacaggtctagacccaggcgatcatctcaaggagaaaagcatgctgtcctatgggaatgtaatcgaccttaaccacctggatattgacgaaccgactggacagacggccgattggttgtctatcgtggtctacctcacctcgttcgtggttcccatactgctgaaggctctctatatgttaacaactaggggccggcagaccacaaaagacaataagggtatgcgcatcagatttaaggacgatagctcattcgaggacgtgaacgggattaggaaacctaagcatctgtttcttagtatgccaaatgcacaatcctctatgaaagccgatgagatcacccccggacggttccgcactgctatttgcggcttgtaccctgcccaggtcaaggcgcgaaacctggtgagcccagtaatgtccgttatcggctttatggcactagccaaaaattggacagaaagagtggaggaatggctcgacctgccctgtaaacttctgtcagagcctagtccaaccagcttgacgaaggggccgtctactaacagggattatctcaatcagcggcagggagctctggccaagatggaaaccaaggaggcacaagctgtccgtaaacacgccatagacgcgggttgcaacattatcgatcatattgactccccctcaagcatctgggtgttcgccggccgccctgatagatgtccacccacatgcttatttatcgcagggatggctgagctgggagccttctttagtgtgctccaggacatgaggaatactattatggcttctaagaccataggcacatccgaagagaaacttcggaagaaaagctcgttctaccagtcttatctgcgacgcacccaatccatgggtatccagttggatcagagaattatcgtcctatttatggttgactgggggaaggaagccgtggactcattccacctgggagatgacatggatcctgagctcaggggcctggcacaggcccttatagaccaaaaggtaaaagaaattagtaaccaggagccactgaagttgtga

SEQ ID NO: 5616 - RNA, 1290 nt, synthetic construct
  misc_feature 1..1290: note = derived and/or modified CDS sequence (opt3) from DOBV(Esl/29Aa/01)__AY533118.2__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaaagtaagatcgatgagttacgccgacagctggctgaccgtgtggccgcagggaagaacattggaaaagaaagagatcctacaggtctagacccaggcgatcatctcaaggagaaaagcatgctgtcctatgggaatgtaatcgaccttaaccacctggatattgacgaaccgactggacagacggccgattggttgtctatcgtggtctacctcacctcgttcgtggttcccatactgctgaaggctctctatatgttaacaactaggggccggcagaccacaaaagacaataagggtatgcgcatcagatttaaggacgatagctcattcgaggacgtgaacgggattaggaaacctaagcatctgtttcttagtatgccaaatgcacaatcctctatgaaagccgatgagatcacccccggacggttccgcactgctatttgcggcttgtaccctgcccaggtcaaggcgcgaaacctggtgagcccagtaatgtccgttatcggctttctagcactcgccaaaaattggacagaaagagtggaggaatggctggaccttccctgtaagctgttgtcagagcctagtccaaccagcctcacgaaagggccgtctactaacagggattatctgaatcagcggcagggagctttagccaagatggaaaccaaggaggcacaagctgtccgtaaacacgccatagacgcgggttgcaacattatcgatcatattgactccccctcaagcatctgggtgttcgccggcgcacctgatcgctgtccacccacatgcctgtttatcgctgggatggccgagctcggagctttctttagtgtgcttcaggacatgagaaatactattatggcctctaagaccataggcacatccgaagagaaactgaggaagaaaagctcgttctaccagtcttatttgcggcgaacccaatccatgggtatccagctagatcagcgcattatcgtcctgtttatggttgactgggggaaggaagcagtggactcattccacctcggagatgacatggatcctgagctgagaggccttgcccaggctctgatagaccaaaaggtaaaagaaattagtaaccaggagccattgaagctctga

SEQ ID NO: 5617 - RNA, 1290 nt, synthetic construct
  misc_feature 1..1290: note = derived and/or modified CDS sequence (opt3) from DOBV(Kurkino/44Aa/98)__AJ131672.1__N
  source 1..1290: mol_type = other RNA
atggccaccctggaggaactccagaaggagatcaacagccacgaaggccaacttgtgattgctagacagaaagtcaaggacgcagagaaacagcatgaaaaggatcccgacgatctgaataaaagggccttgtccgaccgggagtctgttgcgcagtcaatacaaagtaagatcgatgagttacgccgacagctggctgaccgtgtggccgcagggaagaacattggaaaagaaagagatcctacaggtctagacccaggcgatcacctcaaggagaaaagcatgctgtcctacgggaatgtaatcgaccttaaccatctggatattgacgaaccgactggacagacggccgattggttgtctatcgtggtctatctcacctcgttcgtggttcccatactgctgaaggctctctacatgttaacaactaggggccggcagaccacaaaagacaataagggtatgcgcatcagatttaaggacgatagctcattcgaggacgtgaacgggattaggaaacctaagcacctgtttcttagtatgccaaatgcacaatcctctatgaaagccgatgagatcacccccggacggttccgcactgctatttgcggcttgtatcctgcccaggtcaaggcgcgaaacctggtgagcccagtaatgtccgttatcggctttctagcactcgccaaaaattggacagaaagagtggaggaatggctggaccttccctgtaagctgttgtcagagcctagtccaaccagcctcacgaaagggccgtctactaacagggattacctgaatcagcggcaggctgccttagcaaagatggaaaccaaggaggctcaagccgtccgtaaacatgcgatagacgccggatgcacaattatcgattatattgactccccctcaagcatctgggtgttcgctggtgcacctgatcgctgtccacccacttgcctgtttatcgccggcatggctgagctcggggccttctttagtgtgcttcaggacatgagaaacaccattatggcatctaagacagtcggaacctccgaagagaaactgaggaagaaaagctcgttctaccagtcttatttgcggcgaacgcaatccatgggcatacagctagatcagcgcatcattgttctgtttatggtggactggggtaaggaagccgtagactcattccacctcggggatgacatggatcctgagctgagaggacttgctcaggcgctgatcgaccaaaaggtgaaagaaataagtaatagggagccattgaagctctga

SEQ ID NO: 5618 - RNA, 1290 nt, synthetic construct
  misc_feature 1..1290: note = derived and/or modified CDS sequence (opt3) from DOBV(Kurkino/53Aa/98)__AJ131673.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaaagtaagatcgatgagttacgccgacagctggctgaccgtgtggccgcagggaagaacattggaaaagaaagagatcctacaggtctagacccaggcgatcatctcaaggagaaaagcatgctgtcctatgggaatgtaatcgaccttaaccacctggatattgacgaaccgactggacagacggccgattggttgtctatcgtggtctacctcacctcgttcgtggttcccatactgctgaaggctctctatatgttaacaactaggggccggcagaccacaaaagacaataagggtatgcgcatcagatttaaggacgatagctcattcgaggacgtgaacgggattaggaaacctaagcatctgtttcttagtatgccaaatgcacaatcctctatgaaagccgatgagatcacccccggacggttccgcactgctatttgcggcttgtaccctgcccaggtcaaggcgcgaaacctggtgagcccagtaatgtccgttatcggctttctagcactcgccaaaaattggacagaaagagtggaggaatggctggaccttccctgtaagctgttgtcagagcctagtccaaccagcctcacgaaagggccgtctactaacagggattatctgaatcagcggcaggctgccttagcaaagatggaaaccaaggaggctcaagccgtccgtaaacacgcgatagacgccggatgcacaattatcgatcatattgactccccctcaagcatctgggtgttcgctggtgcacctgatcgctgtccacccacttgcctgtttatcgccggcatggctgagctcggggccttctttagtgtgcttcaggacatgagaaacaccattatggcatctaagacagtcggaacctccgaagagaaactgaggaagaaaagctcgttctaccagtcttatttgcggcgaacgcaatccatgggcatacagctagatcagcgcatcattgttctgtttatggtggactggggtaaggaagccgtagactcattccacctcggggatgacatggatcctgagctgagaggacttgctcaggcgctgatcgaccaaaaggtgaaagaaataagtaatagggagccattgaagctctga

SEQ ID NO: 5619 - RNA, 1290 nt, synthetic construct
  misc_feature 1..1290: note = derived and/or modified CDS sequence (opt3) from DOBV(Saar/90Aa/97)__AJ009775.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctatagcgcagtcaatccaagggaagattgatgagttacgccgacagctggctgaccgtgttgccgcaggaaagaacatcggtagagaaagggatcctacaggcctagacccaggggatcatctcaaagagaagagtatgctgagctatggaaatgtgattgaccttaaccacctggatatcgacgaaccgactggccagacggccgattggttgtccatagtaatctacctcacctctttcgtggtccccattctgctgaaagctctctatatgttaacaactcggggtcgccagaccacaaaggacaataaagggatgagaatcaggtttaaggacgattcgtcattcgaggacgtgaacggcattcggaagcctaaacatctgtttcttagcatgccaaatgcacaaagttccatgaaggccgatgagatcacccccggacgcttccgaactgctgtttgcggcttgtaccctgcccaggtgaaagcgagaaacctgatatctccagtcatgagcgtgattgggtttctaacactcgcaaagaattggaccgaaagggtagaggaatggctggaccttccctgtaaactgttgtccgagccttcaccaacgagtctcactaagggaccgagcaccaaccgggattatctgtctcagcgtcagggtgccttagctaaaatggaaacaaaggaggcccaagcagttcgcaagcacgctatcgacgccggctgcaatattatcgatcatatcgactccccctcaagcatttgggtgttcgcgggggcccctgatagatgtccacccacttgcctgtttatagcaggaatggctgagctcggcgccttctttgctgtccttcaggacatgaggaacaccatcatggccagtaaaacaattggtacctctgaagagaagctgcggaaaaagtccagcttctaccagtcgtatttgcgacgcacgcaatctatggggatccagctagatcagagaataattgtgctgtttatgatcgaatggggaaaagaggcagtggactccttccacctcggcgacgatatggaccctgaaatcaggtcactggcccaggctcttattgatcaaaaggtcaaggagatcagtaatcaggagccactgaaattgtga

SEQ ID NO: 5620 - RNA, 1290 nt, synthetic construct
  misc_feature 1..1290: note = derived and/or modified CDS sequence (opt3) from DOBV(SK/Aa)__AY961615.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaaggacattgtccgaccgggagtctgttgcccagtcaatacaaagtaagatcgatgagttacgccgacagctggcggaccgtgtggctgccgggaagaacattggaaaagaaagagatcctactggtctagacccaggcgatcatctcaaggagaaaagcatgctgtcctatgggaatgtaatcgaccttaaccacctggatattgacgaaccgacgggacagaccgcagattggttgtctatcgtggtctacctcacatcgttcgtggttcccatactgctgaaggccctctatatgttaactaccaggggccggcagacaaccaaagacaataagggtatgcgcatcagatttaaggacgatagctcattcgaggacgtgaacgggattaggaaacctaagcatctgtttcttagtatgccaaatgctcaatcctctatgaaagcagatgagatcactcccggacggttccgcacagccatttgcggcttgtaccctgctcaggtcaaggcccgaaacctggtgagcccagtaatgtccgttatcggctttctagcgctcgccaaaaattggaccgaaagagtggaggaatggctggaccttccctgtaagctgttgtcagagcctagtccaacgagcctcactaaagggccgtctaccaacagggattatctgaatcagcggcagggagcattagctaagatggaaacaaaggaggcccaagcagtccgtaaacacgctatagacgccggttgcaacattatcgatcatattgactccccctcaagcatctgggtgttcgcgggcgcccctgatcgctgtccacccacttgcctgtttatcgcagggatggctgagctcggagccttctttagtgtgcttcaggacatgagaaataccattatggcttctaagacaataggcacctccgaagagaaactgaggaagaaaagctcgttctaccagtcttatttgcggcgaacgcaatccatgggtatccagctagatcagcgcattatcgtcctgtttatggttgactgggggaaggaagccgtggactcattccacctcggagatgacatggatcctgagctgagaggccttgcacaggccctgatagaccaaaaggtaaaagaaattagtaaccaggagccattgaagctctga

SEQ ID NO: 5621 - RNA, 1290 nt, synthetic construct
  misc_feature 1..1290: note = derived and/or modified CDS sequence (opt3) from DOBV(A35)__GU904030.1__N
  source 1..1290: mol_type = other RNA
atggccaccctggaggaactccagaaggagatcaacaatcacgaaggccaacttgtgattgctagacagaaagtcaaggacgcagagaaacagtacgaaaaggatcccgacgatctgaacaaaagggccttgagcgaccgggagtccatagcgcagtctatccaagggaagattgatgagttacgccgacagctggctgaccgtgttgccgcaggaaagaatatcggtaaagaaagagatcctacaggcctagacccaggggatcatctcaaggagaaatcaatgctgagttatggaaacgtgattgaccttaatcacctggatatcgacgaaccgactggccagacggccgattggttgagcatagtaatctacctcacctccttcgtggtccccattctgctgaaggctctctatatgttaacaactaggggtcggcagaccacaaaagacaacaaggggatgcgcatcagatttaaggacgattcttcgttcgaggacgtgaatggaattaggaaacctaagcatctgtttctttcaatgccaaacgcacaaagcagtatgaaagccgatgagatcacccccggccggttccgcactgctatatgcggcttgtaccctgcccaggttaaggcgcgaaatctgatttccccagtgatgtctgtcatcgggtttgtggcactagccaaaaactggacagaaagagtagaggaatggctcgacctgccctgtaaacttctgagcgagccttccccaacctcattgacgaagggaccgagtactaatagggattatctcaaccagcggcagggtgctctggccaagatggaaaccaaggaggcacaagctgttcgtaaacacgccattgacgcgggctgcaatttaatcgatcatatcgacagcccctcttccatttgggtgttcgccggggcacctgatcgctgtccacccacatgcctgtttatagctggaatggccgagctcggcgctttctttgccgtccttcaggacatgagaaacactatcatggcatcaaagaccattggtacaagcgaagagaaactgaagaaaaagagttctttctaccagtcctatttgaggcggacccaaagcatggggatccagctagatcagcgaataattgtgctgtttatggtggactggggaaaggaagccgtcgactcgttccacctcggcgatgacatggatcctgagctgcgcggccttgctcaggcgctgatcgaccaaaaagttaaggaaatctctaatcaggagccattgaaactctga

SEQ ID NO: 5622 - RNA, 1290 nt, synthetic construct
  misc_feature 1..1290: note = derived and/or modified CDS sequence (opt3) from DOBV(3970/87)__L41916.1__N
  source 1..1290: mol_type = other RNA
atggccaccctggaggaactccagaaggagatcaacaatcacgaaggccaacttgtgattgctagacagaaagtcaaggacgcagagaaacagtacgaaaaggatcccgacgatctgaacaaaagggccttgagcgaccgggagtccatagcgcagtctatccaagggaagattgatgagttacgccgacagctggctgaccgtgttgccgcaggaaagaatatcggtaaagaaagagatcctacaggcctagacccaggggatcatctcaaggagaaatcaatgctgagttatggaaacgtgattgaccttaatcacctggatatcgacgaaccgactggccagacggccgattggttgagcatagtaatctacctcacctccttcgtggtccccattctgctgaaggctctctatatgttaacaactaggggtcggcagaccacaaaagacaacaaggggatgcgcatcagatttaaggacgattcttcgttcgaggacgtgaatggaattaggaaacctaagcatctgtttctttcaatgccaaacgcacaaagcagtatgaaagccgatgagatcacccccggccggttccgcactgctatatgcggcttgtaccctgcccaggttaaggcgcgaaatctgatttccccagtgatgtctgtcatcgggtttgtggcactagccaaaaactggacagaaagagtagaggaatggctcgacctgccctgtaaacttctgagcgagccttccccaacctcattgacgaagggaccgagtactaatagggattatctcaaccagcggcagggtgctctggccaagatggaaaccaaggaggcacaagctgttcgtaaacacgccattgacgcgggctgcaatttaatcgatcatatcgacagcccctcttccatttgggtgttcgccggggcacctgatcgctgtccacccacatgcctgtttatagctggaatggccgagctcggcgctttctttgcctgtcttcaggacatgagaaacactatcatggcatcaaagaccattggtacaagcgaagagaaactgaagaaaaagagttctttctaccagtcctatttgaggcggacccaaagcatggggatccagctagatcagcgaataattgtcctgtttatggtggactggggaaaggaagccgtggactcgttccacctcggcgatgacatggatcctgagctgcgcggccttgctcaggcgctgatcgaccaaaaagtcaaggaaatctctaatcaggagccattgaaactctga

SEQ ID NO: 5623 - RNA, 1290 nt, synthetic construct
  misc_feature 1..1290: note = derived and/or modified CDS sequence (opt3) from DOBV(Klyuch-2000)__AF442622.1__N
  source 1..1290: mol_type = other RNA
atggccaccctggaggaactccagaaggagatcaacagccacgaaggccaacttgtgattgctagaaggaaagtcaaggacgcagagaaacagtacgaaaaggatcccgacgatctgaataaacgggccttgtccgaccgcgagtctgttgcgcagtcaatacaggggaagatcgatgagttacgacgtcaactggctgacagagtggccgcaggaaagaacattggtaaagaaagggatcctacaggcctagacccaggggatcatctcaaggagaaaagtatgctgagctatggaaatgtaatcgaccttaaccacctggatattgacgaaccgactggccagacggccgattggttgtccatcgtggtctacctcacctctttcgtggttcccatactgctgaaggctctctatatgttaacaactcggggtcgccagaccacaaaagacaataaggggatgagaatcaggtttaaggacgattcgtcattcgaggacgtgaacggcattcggaaacctaagcatctgtttcttagcatgccaaatgcacagagttccatgaaagccgatgagatcacccccggacgcttccgaactgctgtctgcggcttgtaccctgcccaagtgaaggcgagaaacctggtatctccagttatgagcgtgattgggtttgtctccctagcaaagaattggacagaaagggtggaggaatggctcgacctgccctgtaaacttctgtcagagcctagtccaaccagcttgacgaaaggaccgtctactaaccgggattatctcaatcagcgtcagggtgccctggctaagatggaaaccaaggaggcccaggcagtgcgcaaacacgctatcaacgccggctgcaatttagtcgaccatatagattccccctcaagcatttgggttttcgcgggggcccctgacagatgtccacccacatgcctgtttgtggcaggaatggctgagctcggcgccttctttgctgtacttcaagatatgaggaacactatcatggccagtaagaccattggtacatctgaagagaaactgcggaagaaatccagcttctaccagtcgtatttgcgacgcacccagtctatggggatccaactagaccagagaatcattgtgctgtttatggtcgattggggaaaggaagcagtggactccttccacctcggcgacgatatggaccctgagctgaggggccttgcccaggctctgatagaacagaaggttaaagagatctcaaatcaagagccattgaagctctga

SEQ ID NO: 5624 - RNA, 1290 nt, synthetic construct
  misc_feature 1..1290: note = derived and/or modified CDS sequence (opt3) from DOBV(10636/Ap)__KP878311.1__N
  source 1..1290: mol_type = other RNA
atggccaccctggaggaactccagaaggagatcaacaatcacgaaggccaacttgtgattgctagacagaaagtcaaggacgcagagaaacagtacgaaaaggatcccgacgatctgaacaaaagggccttgagcgaccgggagtccgttgcgcagtctatacaagggaagatcgatgagttacgccgacagctggctgaccgtgtggccgcaggaaagaatattggtaaagaaagagatcctacaggcctagacccaggggatcatctcaaggagaaatcaatgctgagttatggaaacgtaatcgaccttaatcacctggatattgacgaaccgactggccagacggccgattggttgagcatcgtggtctacctcacctccttcgtggttcccatactgctgaaggctctctatatgttaacaactaggggtcggcagaccacaaaagacaacaaggggatgcgcatcagatttaaggacgattcttcgttcgaggacgtgaatggaattaggaaacctaagcatctgtttctttcaatgccaaacgcacaaagcagtatgaaagccgatgagatcacccccggccggttccgcactgctgtctgcggcttgtaccctgcccaggtgaaggcgcgaaatctggtatccccagttatgtctgtgattgggtttgtcagcctagcaaagaactggacagaaagagtggaggaatggctcgacctgccctgtaaacttctgtccgagccttcaccaaccagtttgacgaaaggaccgagcactaatagggattatctcaaccagcggcagggtgccctggctaagatggaaaccaaggaggcccaagcagtgcgtaaacacgctatcgacgccggctgcaatttagtcgatcatatagactctccctcctcaatttgggttttcgcgggggcccctgatcgctgtccacccacatgcctgtttgtggcaggaatggctgagctcggcgccttctttgctgtacttcaggacatgagaaacactatcatggccagcaagaccattggtacaagtgaagagaaactgaggaagaaatcttccttctaccagagctatttgcggcgaacccaatcgatggggatccagctagatcagcgcatcattgtgctgtttatggtcgactggggaaaggaagcagtggactctttccacctcggcgatgacatggatcctgagctgagatcccttgcccaggctctgatagaccaaaaggttaaagaaatctcaaatcaggagccattgaagctctga

SEQ ID NO: 5625 - RNA, 1290 nt, synthetic construct
  misc_feature 1..1290: note = derived and/or modified CDS sequence (opt3) from DOBV(10645/Ap)__KP878312.1__N
  source 1..1290: mol_type = other RNA
atggccaccctggaggaactccagaaggagatcaacaatcacgaaggccaacttgtgattgctagacagaaagtcaaggacgcagagaaacagtacgaaaaggatcccgacgatctgaacaaaagggccttgagcgaccgggagtccgttgcgcagtctatacaagggaagatcgatgagttacgccgacagctggctgaccgtgtggccgcaggaaagaatattggtaaagaaagagatcctacaggcctagacccaggggatcatctcaaggagaaatcaatgctgagttatggaaacgtaatcgaccttaatcacctggatattgacgaaccgactggccagacggccgattggttgagcatcgtggtctacctcacctccttcgtggttcccatactgctgaaggctctctatatgttaacaactaggggtcggcagaccacaaaagacaacaaggggatgcgcatcagatttaaggacgattcttcgttcgaggacgtgaatggaattaggaaacctaagcatctgtttctttcaatgccaaacgcacaaagcagtatgaaagccgatgagatcacccccggccggttccgcactgctgtctgcggcttgtaccctgcccaggtgaaggcgcgaaatctggtatccccagttatgtctgtgattgggtttgtcagcctagcaaagaactggacagaaagagtggaggaatggctcgacctgccctgtaaacttctgtccgagccttcaccaaccagtttgacgaaaggaccgagcactaatagggattatctcaaccagcggcagggtgccctggctaagatggaaaccaaggaggcccaagcagtgcgtaaacacgctatcgacgccggctgcaatttagtcgatcatatagactctccctcctcaatttgggttttcgcgggggcccctgatcgctgtccacccacatgcctgtttgtggcaggaatggctgagctcggcgccttctttgctgtacttcaggacatgagaaacactatcatggccagcaagaccattggtacaagtgaagagaaactgaggaagaaatcttccttctaccagagctatttgcggcgaacccaatcgatggggatccagctagatcagcgcatcattgtgctgtttatggtcgactggggaaaggaagcagtggactctttccacctcggcgatgacatggatcctgagctgagaggccttgcccaggctctgatagaccaaaaggttaaagaaatctccaatcaggagccattgaagctctga

SEQ ID NO: 5626 - RNA, 1290 nt, synthetic construct
  misc_feature 1..1290: note = derived and/or modified CDS sequence (opt3) from DOBV(Aa1854/Lipetsk-02)__EU188452.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaaagtaagatcgatgagttacgccgacagctggctgaccgtgtggccgcagggaagaacattggaaaagaaagagatcctacaggtctagacccaggcgatcatctcaaggagaaaagcatgctgtcctatgggaatgtaatcgaccttaaccacctggatattgacgaaccgactggacagacggccgattggttgtctatcgtggtctacctcacctcgttcgtggttcccatactgctgaaggctctctatatgttaacaactaggggccggcagaccacaaaagacaataagggtatgcgcatcagatttaaggacgatagctcattcgaggacgtgaacgggattaggaaacctaagcatctgtttcttagtatgccaaatgcacaatcctctatgaaagccgatgagatcacccccggacggttccgcactgctatttgcggcttgtaccctgcccaggtcaaggcgcgaaacctggtgagcccagtaatgtccgttatcggctttctagcactcgccaaaaattggacagaaagagtggaggaatggctggaccttccctgtaagctgttgtcagagcctagtccaaccagcctcacgaaagggccgtctactaacagggattatctgaatcagcggcaggctgccttagcaaagatggaaaccaaggaggctcaagccgtccgtaaacacgcgatagacgccggatgcacaattatcgatcatattgactccccctcaagcatctgggtgttcgctggtgcacctgatcgctgtccacccacttgcctgtttatcgccggcatggctgagctcggggccttctttagtgtgcttcaggacatgagaaacaccattatggcatctaagcctgtcggaacatccgaagagaaactgaggaagaaaagctcgttctaccagtcttatttgcggcgaacccaatccatgggcatacagctagatcagcgcatcattgttctgtttatggtggactggggtaaggaagccgtagactcattccacctcggggatgacatggatccagagctgagaggacttgctcaggcgctgatcgaccaaaaggtgaaagaaataagtaatcaggagcccttgaagctctga

SEQ ID NO: 5627 - RNA, 1290 nt, synthetic construct
  misc_feature 1..1290: note = derived and/or modified CDS sequence (opt3) from DOBV(Ap/Sochi/43)__JF920151.1__N
  source 1..1290: mol_type = other RNA
atggccaccctggaggaactccagaaggagatcaacaatcacgaaggccaacttgtgattgctagacagaaagtcaaggacgcagagaaacagtacgaaaaggatcccgacgatctgaacaaaagggccttgagcgaccgggagtccgttgcgcagtctatacaagggaagatcgatgagttacgccgacagctggctgaccgtgtggccgcaggaaagaatattggtaaagaaagagatcctacaggcctagacccaggggatcatctcaaggagaaatcaatgctgagttatggaaacgtaatcgaccttaatcacctggatattgacgaaccgactggccagacggccgattggttgagcatcgtggtctacctcacctccttcgtggttcccatactgctgaaggctctctatatgttaacaactaggggtcggcagaccacaaaagacaacaaggggatgcgcatcagatttaaggacgattcttcgttcgaggacgtgaatggaattaggaaacctaagcatctgtttctttcaatgccaaacgcacaaagcagtatgaaagccgatgagatcacccccggccggttccgcactgctgtctgcggcttgtaccctgcccaggtgaaggcgcgaaatctggtatccccagttatgtctgtgattgggtttgtcagcctagcaaagaactggacagaaagagtggaggaatggctcgacctgccctgtaaacttctgtccgagccttcaccaaccagtttgacgaaaggaccgagcactaatagggattatctcaaccagcggcagggtgccctggctaagatggaaaccaaggaggcccaagcagtgcgtaaacacgctatcgacgccggctgcaatttagtcgatcatatagactctccctcctcaatttgggttttcgcgggggcccctgatcgctgtccacccacatgcctgtttgtggcaggaatggctgagctcggcgccttctttgctgtacttcaggacatgagaaacactatcatggccagcaagaccattggtacaagtgaagagaaactgaggaagaaatcttccttctaccagagctatttgcggcgaacccactcgatggggatccaactagatcagcgcatcattgtgctgtttatggtcgactggggaaaggaagcagtggactctttccacctcggcgatgacatggatcctgagctgagaggccttgcccaggctctgatagaccagaaggttaaagaaatctccaatcaagagccattgaagctctga

SEQ ID NO: 5628 - RNA, 1290 nt, synthetic construct
  misc_feature 1..1290: note = derived and/or modified CDS sequence (opt3) from DOBV(Ap/Sochi/hu)__JF920150.1__N
  source 1..1290: mol_type = other RNA
atggccaccctggaggaactccagaaggagatcaacaatcacgaaggccaacttgtgattgctagacagaaagtcaaggacgcagagaaacagtacgaaaaggatcccgacgatctgaacaaaagggccttgagcgaccgggagtccgttgcgcagtctatacaagggaagatcgatgagttacgccgacagctggctgaccgtgtggccgcaggaaagaatattggtaaagaaagagatcctacaggcctagacccaggggatcatctcaaggagaaatcaatgctgagttatggaaacgtaatcgaccttaatcacctggatattgacgaaccgactggccagacggccgattggttgagcatcgtggtctacctcacctccttcgtggttcccatactgctgaaggctctctatatgttaacaactaggggtcggcagaccacaaaagacaacaaggggatgcgcatcagatttaaggacgattcttcgttcgaggacgtgaatggaattaggaaacctaagcatctgtttctttcaatgccaaacgcacaaagcagtatgaaagccgatgagatcacccccggccggttccgcactgctgtctgcggcttgtaccctgcccaggtgaaggcgcgaaatctggtatccccagttatgtctgtgattgggtttctaagcctcgccaaaaactggacagaaagagtcgaggaatggctggaccttccctgtaagctgttgtccgagccttcaccaaccagtctcacgaaaggaccgagcactaatagggattatctgaaccagcggcagggtgcattagctaagatggaaaccaaggaggcccaagcagtgcgtaaacacgctatcgacgccggctgcaatctggtggatcatatagactctccctcctcaatttgggtcttcgcgggggcccctgatcgctgtccacccacatgcctctttgttgcaggaatggctgagcttggcgccttctttgctgtgctgcaggacatgagaaacactatcatggccagcaagaccattggtacaagtgaagagaaattgaggaagaaatcttccttctaccagagctatctacggcgaacccactcgatggggatccaactggatcagcgcatcattgtactctttatggtggactggggaaaggaagcagtcgactctttccacctgggcgatgacatggatcctgagcttagaggcctggcccaggctttgatagaccagaaggtgaaagaaatctccaatcaagagccactcaagctgtga

SEQ ID NO: 5629 - RNA, 1290 nt, synthetic construct
  misc_feature 1..1290: note = derived and/or modified CDS sequence (opt3) from DOBV(Ap1584/Sochi-01)__EU188449.1__N
  source 1..1290: mol_type = other RNA
atggccaccctggaggaactcaagaaagagatcaacaatcacgaaggccagcttgtgattgctagacaaaaggtcaaagacgcagagaagcagtacgaaaaagatcccgacgatctgaacaagagggccttgagcgaccgggagtccgttgcgcagtctatacaggggaagatcgatgagttacgccgacaactggctgaccgtgtggccgcaggtaaaaatattggaaaggaaagagatcctacaggcctagacccaggggatcatctcaaagagaagtcaatgctgagttatggaaacgtaatcgaccttaatcacctggatattgacgaaccgactggccagacggccgattggttgagcatcgtggtctacctcacctccttcgtggttcccatactgctgaaagctctctatatgttaacaactaggggtcggcagaccacaaaggacaacaaggggatgcgcatcagatttaaagacgattcttcgttcgaggacgtgaatggaattaggaagcctaaacatctgtttctttcaatgccaaacgcacagagcagtatgaaggccgatgagatcacccccggccggttccgcactgctgtctgcggcttgtaccctgcccaagtgaaagcgcgaaatctggtatccccagttatgtctgtgattgggtttgtcagcctagcaaagaactggacagaaagagtggaggaatggctcgacctgccctgtaaacttctgtccgagccttcaccaaccagtttgacgaagggaccgagcactaatagggattatctcaaccagcggcagggtgccctggctaagatggaaaccaaagaggcccaggcagtgcgtaagcacgctatcgacgccggctgcaatttagtcgatcatatagactctccctcctcaatttgggttttcgcgggggcccctgatcgctgtccacccacatgcctgtttgtggcaggaatggctgagctcggcgccttctttgctgtacttcaagacatgagaaacactatcatggccagcaaaaccattggtacaagtgaagagaagctgaggaaaaagtcttccttctaccagagctatttgcggcgaacccagtcgatggggatccaactagatcagcgcatcattgtgctgtttatggtcgactggggaaaggaagcagtggactctttccacctcggcgatgacatggatcctgagctgagaggccttgcccaggctctgatagaccagaaagttaaggaaatctccaatcaagagccattgaaactctga

SEQ ID NO: 5630 - RNA, 1290 nt, synthetic construct
  misc_feature 1..1290: note = derived and/or modified CDS sequence (opt3) from DOBV(DOB/Gola/235Af/07)__KC848495.1__N
  source 1..1290: mol_type = other RNA
atggccaccctggaggaactccagaaggagatcaacaatcacgaaggccaacttgtgattgctagacagaaagtcaaggacgcagagaaacagtacgaaaaggatcccgacgatctgaacaaaagggccttgagcgaccgggagtccatagcgcagtctatccaagggaagattgatgagttacgccgacagctggctgaccgtgttgccgcaggaaagaatatcggtaaagaaagagatcctacaggcctagacccaggggatcatctcaaggagaaatcaatgctgagttatggaaacgtgattgaccttaatcacctggatatcgacgaaccgactggccagacggccgattggttgagcatagtagtgtacctcacctccttcgtcgtgcccatcctgctgaaggctctctatatgttaacaactaggggtcggcagaccacaaaagacaacaaggggatgcgcattagatttaaggacgattcttcgttcgaggacgttaatggaatcaggaaacctaagcatctgtttctttcaatgccaaacgcacaaagcagtcggaaagccgatgagattacccccggccgcttccgaactgctatctgcggcttgtaccctgcccaggtgaaggcgagaaatctgatatccccagtcatgtctgtgattgggtttctagcactcgccaaaaactggacagaaagggtagaggaatggctggaccttccctgtaagctgttgagcgagccttccccaacctcactcacgaaaggaccgagtactaatcgggattatctgaaccagcgtcagggtgctttagccaagatggaaaccaaggaggcacaagctgttcgcaaacacgccatcgacgcgggctgcaatctgattgatcatatcgacagcccctcttccatctgggtgttcgccggggcacctgatagatgtccacccacatgcctctttattgctggaatggccgagcttggcgctttctttgccgtcctgcaggacatgaggaacactataatggcatcaaagaccatcggtacaagcgaagagaaattgaagaaaaagagttctttctaccagtcctatctacggcgaacccaaagcatggggattcagctggatcagcgcatcatagtgctctttatggtggactggggaaaggaagccgtcgactcgttccacctgggcgatgacatggatcctgagcttagaggcctggctcaggcgttgattgaccaaaaagttaaggaaatctctaatcaggagccactcaaactgtga

SEQ ID NO: 5631 - RNA, 1290 nt, synthetic construct
  misc_feature 1..1290: note = derived and/or modified CDS sequence (opt3) from DOBV(DOB/Gola/343Af/07)__KC848498.1__N
  source 1..1290: mol_type = other RNA
atggccaccctggaggaactccagaaggagatcaacaatcacgaaggccaacttgtgattgctagacagaaagtcaaggacgcagagaaacagtacgaaaaggatcccgacgatctgaacaaaagggccttgagcgaccgggagtccatagcgcagtctatccaagggaagattgatgagttacgccgacagctggctgaccgtgttgccgcaggaaagaatatcggtaaagaaagagatcctacaggcctagacccaggggatcatctcaaggagaaatcaatgctgagttatggaaacgtgattgaccttaatcacctggatatcgacgaaccgactggccagacggccgattggttgagcatagtagtgtacctcacctccttcgtcgtgcccatcctgctgaaggctctctatatgttaacaactaggggtcggcagaccacaaaagacaacaaggggatgcgcattagatttaaggacgattcttcgttcgaggacgttaatggaatcaggaaacctaagcatctgtttctttcaatgccaaacgcacaaagcagtatgaaagccgatgagattacccccggccggttccgcactgctatctgcggcttgtaccctgcccaggtgaaggcgcgaaatctgatatccccagtcatgtctgtgattgggtttctagcactcgccaaaaactggacagaaagagtagaggaatggctggaccttccctgtaagctgttgagcgagccttccccaacctcactcacgaaaggaccgagtactaatagggattatctgaaccagcggcagggtgctttagccaagatggaaaccaaggaggcacaagctgttcgtaaacacgccacagacgcgggctgcaatctgatcgatcatattgacagcccctcttccatctgggtgttcgccggggcacctgatcgctgtccacccacttgcctctttatcgctggaatggccgagcttggcgctttctttgccgtcctgcaggacatgagaaacaccattatggcatcaaagacaataggtaccagcgaagagaaattgaagaaaaagagttctttctaccagtcctatctaaggcggacgcaaagcatggggatccagctggatcagcgaattatcgtgctctttatggtggactggggaaaggaagccgtcgactcgttccacctgggcgatgacatggatcctgagcttcgcggcctggctcaggcgttgatagaccaaaaagttaaggaaatttctaatcaggagccactcaaactgtga

SEQ ID NO: 5632 - RNA, 1290 nt, synthetic construct
  misc_feature 1..1290: note = derived and/or modified CDS sequence (opt3) from DOBV(DOB/Pecs/27Aa/06)__KC848499.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaaagtaagatcgatgagttacgccgacagctggctgaccgtgtggccgcagggaagaacattggaaaagaaagagatcctacaggtctagacccaggcgatcatctcaaggagaaaagcatgctgtcctatgggaatgtaatcgaccttaaccacctggatattgacgaaccgactggacagacggccgattggttgtctatcgtggtctacctcacctcgttcgtggttcccatactgctgaaggctctctatatgttaacaactaggggccggcagaccacaaaagacaataagggtatgcgcgtgagatttaaggacgatagctcattcgaggacgtcaacgggatcaggaaacctaagcatctgtttcttagtatgccaaatgcacaatcctctatgaaagccgatgagattacccccggacggttccgcactgctgtgtgcggcttgtaccctgcccaggtaaaggcgcgaaacctggttagcccagtgatgtccgtcatcggctttctagcactcgccaaaaattggacagaaagagtggaggaatggctggaccttccctgtaagctgttgtcagagcctagtccaaccagcctcacgaaagggccgtctactaacagggattatctgaatcagcggcagggagctttagccaagatggaaaccaaggaggcacaagctgtgcgtaaacacgccattgacgcgggttgcaacatcatagatcatattgactccccctcaagcatctgggtcttcgccggcgcacctgatcgctgtccacccacatgcctgtttattgctgggatggccgagctcggagctttctttagtgttcttcaggacatgagaaatactatcatggcctctaagaccatcggcacatccgaagagaaactgaggaagaaaagctcgttctaccagtcttatttgcggcgaacccaatccatgggtattcagctagatcagcgcataatcgtgctgtttatggtagactgggggaaggaagcagtggactcattccacctcggagatgacatggatcctgagctgagaggccttgcccaggctctgattgaccaaaaggtcaaagaaatcagtaaccaggagccattgaagctctga

SEQ ID NO: 5633 - RNA, 1290 nt, synthetic construct
  misc_feature 1..1290: note = derived and/or modified CDS sequence (opt3) from DOBV(DOB/Pecs/31Aa/06)__KC848500.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaaagtaagatcgatgagttacgccgacagctggctgaccgtgtggccgcagggaagaacattggaaaagaaagagatcctacaggtctagacccaggcgatcatctcaaggagaaaagcatgctgtcctatgggaatgtaatcgaccttaaccacctggatattgacgaaccgactggacagacggccgattggttgtctatcgtggtctacctcacctcgttcgtggttcccatactgctgaaggctctctatatgttaacaactaggggccggcagaccacaaaagacaataagggtatgcgcatcagatttaaggacgatagctcattcgaggacgtgaacgggattaggaaacctaagcatctgtttcttagtatgccaaatgcacaatcctctatgaaagccgatgagatcacccccggacggttccgcactgctgtctgcggcttgtaccctgcccaggtgaaggcgcgaaacctggtaagcccagttatgtccgtgattggctttctagcactcgccaaaaattggacagaaagagtcgaggaatggctggaccttccctgtaagctgttgtcagagcctagtccaaccagcctcacgaaagggccgtctactaacagggattatctgaatcagcggcagggagctttagccaagatggaaaccaaggaggcacaagctgtgcgtaaacacgccatcgacgcgggttgcaacataattgatcatatcgactccccctcaagcatttgggtgttcgccggcgcacctgatcgctgtccacccacatgcctgtttatcgctgggatggcccagctcggagctttctttagtgtccttcaggacatgagaaatactatcatggcctctaagaccattggcacatccgaggaaaaactgaggaagaaaagctcgttctaccaatcttatttgcggcgaacccagtccatgggtatacagctagatcagcgcatcattgttctgtttatggtggactgggggaaggaggcagtagactcattccacctcggagatgacatggatcctgaactgagaggccttgcccaagctctgatcgaccagaagatgaaagagataagtaaccaggaaccattgaagctctga

SEQ ID NO: 5634 - RNA, 1290 nt, synthetic construct
  misc_feature 1..1290: note = derived and/or modified CDS sequence (opt3) from DOBV(DOB/Sarmellek/77Aa/06)__KC848501.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaaagtaagatcgatgagttacgccgacagctggctgaccgtgtggccagcgggaagaacattggaaaagaaagagatcctacaggtctagacccaggcgatcatctcactgagaagtccatgctgtcttatgggaatgtaatcgaccttaaccacctggatattgacgaaccgacgggacagaccgcagattggttgtcgatcgtggtctacctcacatcattcgtggttcccatactgctgaaagccctctatatgttaactaccaggggccggcagacaaccaaggacaataaaggtatgcgcatcagatttaaggacgatagcagtttcgaggacgtgaacgggattaggaagcctaaacatctgtttctttccatgccaaatgctcaatctagcatgaaggcagatgagatcactcccggacggttccgcacagccatttgcggcttgtaccctgctcaggtcaaagcccgaaacctggtgtccccagtaatgtcagttatcggctttctagcgctcgcaaagaattggaccgaaagagtggaggaatggctggaccttccctgtaaactgttgagtgagcctagcccaacgtctctcactaaggggccgtccaccaacagggattatctgaatcagcggcagggagccttagctaaaatggaaacaaaggaggcccaagcagtccgtaagcacgctatagacgccggttgcaacattatcgatcatattgactcacccagcagtatctgggtgttcgcgggcgcccctgatcgctgtccacccacttgcctgtttatcgcagggatggctgagctcggagccttcttttctgtgcttcaggacatgagaaataccattatggcttccaaaacagtcggcaccagcgaagagaagctgaggaaaaagtcgtctttctaccagtcctatttgcggcgaacgcaatcaatgggtatacagctagatcagcgcatcattgttctgtttatggtggactgggggaaagaagccgtagacagtttccacctcggagatgacatggatcctgagctgagaagccttgcacaggccctgatcgaccaaaaggtgaaggaaatatccaaccaggagccattgaaactctga

SEQ ID NO: 5635 - RNA, 1290 nt, synthetic construct
  misc_feature 1..1290: note = derived and/or modified CDS sequence (opt3) from DOBV(GER/05/239/Aa)__GQ205405.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaagggaagatcgatgagttacgccgacagctggctgaccgtgtggccgcaggaaagaacattggtaaagaaagagatcctacaggcctagacccaggggatcatctcaaggagaaaagtatgctgagctatggaaatgtaatcgaccttaaccacctggatattgacgaaccgactggccagacggccgattggttgtccatcgtggtctacctcacctctttcgtggttcccatactgctgaaggctctctatatgttaacaactaggggtcggcagaccacaaaagacaataaggggatgcgcatcagatttaaggacgattcgtcattcgaggacgtgaacggaattaggaaacctaagcatctgtttcttagcatgccaaatgcacaaagttccatgaaagccgatgagatcacccccggccggttccgcactgctatttgcggcttgtaccctgcccaggtcaaggcgcgaaacctggtgtctccagtaatgagcgttatcgggtttctagcactcgccaaaaattggacagaaagagtggaggaatggctggaccttccctgtaagctgttgtccgagccttcaccaaccagtctcacgaaaggaccgagcactaacagggattatctgtctcagcggcagggtgctttagccaagatggaaaccaaggaggcacaagctgtccgtaaacacgccatagacgcgggctgcaatattatcgatcatattgactccccctcaagcatctgggtgttcgccggggcacctgatcgctgtccacccacatgcctgtttatcgctggaatggccgagctcggcgctttctttgccgtgcttcaggacatgagaaacactattatggcaagtaagaccataggtacatctgaagagaaactgaggaagaaatccagcttctaccagtcgtatttgcggcgaacccaatctatggggatccagctagatcagcgcattatcgtcctgtttatggttgactggggaaaggaagccgtggactccttccacctcggcgatgacatggatcctgagctgagatcacttgctcaggcgctgatagaccaaaaggtaaaagaaattagtaatcaggagccattgaagctctga

SEQ ID NO: 5636 - RNA, 1290 nt, synthetic construct
  misc_feature 1..1290: note = derived and/or modified CDS sequence (opt3) from DOBV(GER/05/477/Af)__GQ205406.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaagggaagatcgatgagttacgccgacagctggctgaccgtgtggccgcaggaaagaacattggtaaagaaagagatcctacaggcctagacccaggggatcatctcaaggagaaaagtatgctgagctatggaaatgtaatcgaccttaaccacctggatattgacgaaccgactggccagacggccgattggttgtccatcgtggtctacctcacctctttcgtggttcccatactgctgaaggctctctatatgttaacaactaggggtcggcagaccacaaaagacaataaggggatgcgcatcagatttaaggacgattcgtcattcgaggacgtgaacggaattaggaaacctaagcatctgtttcttagcatgccaaatgcacaaagttccatgaaagccgatgagatcacccccggccggttccgcactgctatttgcggcttgtaccctgcccaggtcaaggcgcgaaacctggtgtctccagtaatgagcgttatcgggtttctagcactcgccaaaaattggacagaaagagtggaggaatggctggaccttccctgtaagctgatatccgagccttcaccaaccagtttgacgaaaggaccgagcactaacagggattatctctctcagcggcagggtgctctggccaagatggaaaccaaggaggcacaagctgtccgtaaacacgccattgacgcgggctgcaatatcattgatcatatcgactccccctcaagcatctgggtgttcgccggggcacctgatcgctgtccacccacatgcttatttattgctggaatggccgagctgggcgctttctttgccgtgctccaggacatgagaaacactataatggcaagtaagaccatcggtacatctgaagagaaacttaggaagaaatccagcttctaccagtcgtatctgcggcgaacccaatctatggggattcagttggatcagcgcatcatagtcctatttatggttgactggggaaaggaagccgtggactccttccacctgggcgatgacatggatcctgagctcagatcactggctcaggcgcttattgaccaaaaggtaaaagaaatcagtaatcaggagccactgaagttgtga

SEQ ID NO: 5637 - RNA, 1290 nt, synthetic construct
  misc_feature 1..1290: note = derived and/or modified CDS sequence (opt3) from DOBV(GER/07/293/Aa)__GQ205401.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaagggaagatcgatgagttacgccgacagctggctgaccgtgtggccgcaggaaagaacattggtaaagaaagagatcctacaggcctagacccaggggatcatctcaaggagaaaagtatgctgagctatggaaatgtaatcgaccttaaccacctggatattgacgaaccgactggccagacggccgattggttgtccatcgtggtctacctcacctctttcgtggttcccatactgctgaaggctctctatatgttaacaactaggggtcggcagaccacaaaagacaataaggggatgcgcatcagatttaaggacgattcgtcattcgaggacgtgaacggaattaggaaacctaagcatctgtttcttagcatgccaaatgcacaaagttccatgaaagccgatgagatcacccccggccggttccgcactgctatttgcggcttgtaccctgcccaggtcaaggcgcgaaacctggtgtctccagtaatgagcgttatcgggtttctagcactcgccaaaaattggacagaaagagtggaggactggctggatcttccctgtaagctgttgtccgaaccttcaccaaccagtctcacgaaaggaccgagcactaacagggactatctgaatcagcggcagggtgctttagccaagatggagaccaaggaagcacaagctgtccgtaaacacgccatagatgcgggctgcaacattatcgaccatattgattctccctcctcaatctgggtgttcgccggggcacctgaccgctgtccacccacatgcctgtttatcgctggaatggccgagctcggcgctttctttgccgtgcttcaggatatgagaaatactattatggcaagcaagaccataggtacaagtgaggaaaaactgaggaagaaatcttccttctaccagagctatttgcggcgaacccaatcgatggggatccagctagaccagcgcattatcgtcctgctcatggttgactggggaaaggaggccgtggattcttttcacctgggcgacgatatggaccctgaacttagaggcctggctcaggcgttgatagatcaaaaggtaaaagagatttccaaccaggaaccactcaagctgtga

SEQ ID NO: 5638 - RNA, 1290 nt, synthetic construct
  misc_feature 1..1290: note = derived and/or modified CDS sequence (opt3) from DOBV(GER/07/424/Aa)__GQ205403.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaagggaagatcgatgagttacgccgacagctggctgaccgtgtggccgcaggaaagaacattggtaaagaaagagatcctacaggcctagacccaggggatcatctcaaggagaaaagtatgctgagctatggaaatgtaatcgaccttaaccacctggatattgacgaaccgactggccagacggccgattggttgtccatcgtggtctacctcacctctttcgtggttcccatactgctgaaggctctctatatgttaacaactaggggtcggcagaccacaaaagacaataaggggatgcgcatcagatttaaggacgattcgtcattcgaggacgtgaacggaattaggaaacctaagcatctgtttcttagcatgccaaatgcacaaagttccatgaaagccgatgagatcacccccggccggttccgcactgctatttgcggcttgtaccctgcccaggtcaaggcgcgaaacctggtgtctccagtaatgagcgttatcgggtttctagcactcgccaaaaattggacagaaagagtggaggactggctggatcttccctgtaagctgttgtccgaaccttcaccaaccagtctcacgaaaggaccgagcactaacagggactatctgaatcagcggcagggtgctttagccaagatggagaccaaggaagcacaagctgtccgtaaacacgccatagatgcgggctgcaacattatcgaccatattgattctccctcctcaatctgggtgttcgccggggcacctgaccgctgtccacccacatgcctgtttatcgctggaatggccgagctcggcgctttctttgccgtgcttcaggatatgagaaatactattatggcaagcaagaccataggtacaagtgaggaaaaactgaggaagaaatcttccttctaccagagctatttgcggcgaacccaatcgatggggatccagctagaccagcgcattatcgtcctgtttatggttgactggggaaaggaggccgtggattctttccacctcggcgacgatatggaccctgaactgagaggccttgctcaggcgctgatagatcaaaaggtaaaagagatttccaaccaggaaccattgaagctctga

SEQ ID NO: 5639 - RNA, 1290 nt, synthetic construct
  misc_feature 1..1290: note = derived and/or modified CDS sequence (opt3) from DOBV(GER/08/118/Aa)__GQ205407.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaagggaagatcgatgagttacgccgacagctggctgaccgtgtggccgcaggaaagaacattggtaaagaaagagatcctacaggcctagacccaggggatcatctcaaggagaaaagtatgctgagctatggaaatgtaatcgaccttaaccacctggatattgacgaaccgactggccagacggccgattggttgtccatcgtggtctacctcacctctttcgtggttcccatactgctgaaggctctctatatgttaacaactaggggtcggcagaccacaaaagacaataaggggatgcgcatcagatttaaggacgattcgtcattcgaggacgtgaacggaattaggaaacctaagcatctgtttcttagcatgccaaatgcacaaagttccatgaaagccgatgagatcacccccggccggttccgcactgctatttgcggcttgtaccctgcccaggtcaaggcgcgaaacctggtgtctccagtaatgagcgttatcgggtttctagcactcgccaaaaattggacagaaagagtggaggactggctggatcttccctgtaagctgttgtccgaaccttcaccaaccagtctcacgaaaggaccgagcactaacagggactatctgaatcagcggcagggtgctttagccaagatggagaccaaggaagcacaagctgtccgtaaacacgccatagatgcgggctgcaacattatcgaccatattgattctccctcctcaatctgggtgttcgccggggcacctgaccgctgtccacccacatgcctgtttatcgctggaatggccgagctcggcgctttctttgccgtgcttcaggatatgagaaatactattatggcaagcaagaccgtcggtacaagtgaggagaaaatgaggaagaaatcttccttctaccagagctatctgcggcgaacccaatcgatggggatacagttggaccagcgcatcattgttctatttatggtggactggggaaaggaagccgtagattctttccacctgggcgacgatatggaccctgaactcagaggcctggctcaggcgcttatcgatcaaaaggtgaaagagatatccaaccaggaaccactgaagttgtga

SEQ ID NO: 5640 - RNA, 1290 nt, synthetic construct
  misc_feature 1..1290: note = derived and/or modified CDS sequence (opt3) from DOBV(GER/08/131/Af)__GQ205408.1__N
  source 1..1290: mol_type = other RNA
atggccaccctggaggaactccagaaggagatcaacagccacgaaggccaacttgtgattgctagacagaaagtcaaggacgcagagaaacagtacgaaaaggatcccgacgatctgaataaaagggccttgtccgaccgggagtctgttgcgcagtcaatacaagggaagatcgatgagttacgccgacagctggctgaccgtgtggccgcaggaaagaacattggtaaagaaagagatcctacaggcctagacccaggggatcatctcaaggagaaaagtatgctgagctatggaaatgtaatcgaccttaaccacctggatattgacgaaccgactggccagacggccgattggttgtccatcgtggtctacctcacctctttcgtggttcccatactgctgaaggctctctatatgttaacaactaggggtcggcagaccacaaaagacaataaggggatgcgcatcagatttaaggacgattcgtcattcgaggacgtgaacggaattaggaaacctaagcatctgtttcttagcatgccaaatgcacaaagttccatgaaagccgatgagatcacccccggccggttccgcactgctgtctgcggcttgtaccctgcccaggtgaaggcgcgaaacctggtatctccagttatgagcgtgattgggtttctagcactcgccaaaaattggacagaaagagtcgaggactggctggatcttccctgtaagctgttgtccgaaccttcaccaaccagtctcacgaaaggaccgagcactaacagggactatctgaatcagcggcagggtgctttagccaagatggagaccaaggaagcacaagctgtgcgtaaacacgccatcgatgcgggctgcaacataattgaccatatcgattctccctcctcaatttgggtgttcgccggggcacctgaccgctgtccacccacatgcctgtttatcgctggaatggccgagctcggcgctttctttgccgtccttcaggatatgagaaatactatcatggcaagcaagaccattggtacaagtgaggaaaaactgaggaagaaatcttccttctaccagagctatttgcggcgaacccaatcgatggggatacagctagaccagcgcatcattgttctgtttatggtggactggggaaaggaggccgtagattctttccacctcggcgacgatatggaccctgaactgagaggccttgctcaggcgctgatcgatcaaaaggtgaaagagatatccaaccaggaaccattgaagctctga

SEQ ID NO: 5641 - RNA, 1290 nt, synthetic construct
  misc_feature 1..1290: note = derived and/or modified CDS sequence (opt3) from HTNV(76-118/POR)__KT885049.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacaaaccgagagggggttgctgtgagcatacaggccaagatcgatgaattgaaaatgcaattagcagaccgtattgccactggaaagaatctgggtaaggagcaggatcctacgggcgtagaaccaggggaccatctaaaagagagatccatgctctcttatggaaacgtgctggatcttaatcacctggacatcgatgagccgaccggccagacagctgactggttgtcaattatcgtctacctcaccagtttcgtggttcccatactgctgaaggcactctatatgttaactacaaggggtcggcagaccactaaagataacaaggggacacgcatcagatttaaagacgatagctccttcgaagacgtgaatggaattaggaagcctaagcatctgtacgtctctcttccaaacgcccaatcgtcaatgaaagctgaggaaatcacccccggccggtatcgcacggccgtgtgcggcttgtaccctgcgcagattaaggcacgacagatgatcagcccagtaatgagtgttatagggtttctggccctagctaaagactggtccgatagaattgagcagtggctcatcgaaccctgtaagctgcttcctgacactgccgcagtgtctctgttgggaggtccagctaccaatagggattatctccggcaacgtcaggtcgccctgggcaacatggagacaaaagagagcaaggcgattcgccagcacgccgaagcagctgggtgctccatgatcgaggacatcgaatcaccgagtagcatttgggtgttcgccggagctcccgatagatgtcctccaacttgcttatttatagccggcatcgcagagctgggtgccttcttttctattctccaagacatgaggaataccatcatggcttccaaaacagtggggacctcagaagagaagctgcggaagaaaagcagtttctaccagtcttaccttcgacgcacgcagtccatgggaatacagttggatcaaagaattatcgtcctatttatggttgcgtggggcaaggaggcagtggacaacttccatctgggcgatgacatggatcccgaactcaggactctggcccagagccttatcgacgtaaaagtgaaggagatttcgaatcaggaacctctgaaattgtga

SEQ ID NO: 5642 - RNA, 1290 nt, synthetic construct
  misc_feature 1..1290: note = derived and/or modified CDS sequence (opt3) from HTNV(A16)__AF288646.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagaggggttggctgccagcatacaggcaaagatcgacgaattaaaacgtcaactggccgatagaattgctactggaaagaacctaggtaaggagcaggaccctacgggcgttgaaccaggggatcatctcaaagagaggtccatgctgtcttatggaaatgtgcttgacctgaaccacttggatatcgacgagccgaccggccagacagcagattggctctcaattgtaatctacctgaccagtttcgtggtccccatactgctcaaggccttatatatgctgactacacggggtcgccagaccactaaagacaataaggggacaagaatcaggtttaaagatgacagctccttcgaagacgtgaacggcattcggaagcctaagcatctttacgtttctttgccaaatgctcaatcgtcaatgaaagccgaggaaatcacccccggacgctatcgaacggcgatttgcggcctgtaccctgcacagatcaaggccagacagatgataagcccagtgatgagtgtcattgggtttctagctctcgccaaagattggtccgacaggatcgagcagtggctgtctgaaccctgtaaacttctgcctgatactgcagctgtgagcttgcacggaggtccagccaccaaccgggactatctccgtcaacgccaggtagcgctgggcaatatggagacaaaggagtccaaggccattagacagcatgcagaatcagctgggtgcagtatggttgaggatatcgaaagcccgtcttccatctgggtgttcgccggagctcccaacaggtgtcctccaacttgcttatttattgccggcatagcagagctgggtgccttcttttcaatcctccaagacatgcggaataccattatggctagcaaaacagtcgggaccagtgaagagaaacttcgaaagaagtcttccttctaccagagctacctgcgcagaacgcagtcgatgggaatccagttggatcaaaggataattgtgctatttatggtggcgtggggcaaggaggcagtcgacaacttccacctgggcgatgacatggatcccgttctccggactctggcccagtctcttatcgacgtgaaagtaaaggaaatctccaatcaggagcctctgaaattgtga

SEQ ID NO: 5643 - RNA, 1290 nt, synthetic construct
  misc_feature 1..1290: note = derived and/or modified CDS sequence (opt3) from HTNV(CA09082007)__HQ834499.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtgatctacctcaccagtttcgtcgtgcccatactgctgaaggccctctatatgttaactacacggggtcgccagaccactaaagacaataaggggacaagaatcaggtttaaagatgacagctccttcgaagacgttaacggcattcggaagcctaagcatctgtacgtgtctcttccaaatgctcaatcgtcaatgaaagccgaggaaatcacccccggacgctatcgaacggcgatttgcggcttgtaccctgcacagatcaaggccagacagatgataagcccagtcatgagtgtgattgggtttctggctctagccaaagattggtccgacaggatcgagcagtggctctctgaaccctgtaagctgcttcctgatactgcagctgtaagcctgcacggaggtccagccaccaaccgggactatttgcgtcaacgccaggttgcgctcggcaatatggagacaaaagagtccaaggccattagacagcatgcagaatcagctgggtgcagtatggtggaggatatcgaaagcccgtcttccatctgggtcttcgccggagctcccgacaggtgtcctccaacttgcctgtttattgccggcatagcagagttaggtgccttcttttcaatcctgcaagatatgcggaacaccattatggctagcaaaacagtggggaccagtgaagagaagctccgaaagaaatcttccttctaccagagctacatccgcagaacgcagtcgatgggaatacagcttgaccaaaggattatcgtgctgtttatggtcgcgtggggcaaggaggcagttgataatttccacttgggcgacgatatggaccccgaactacggactctggcccagtctctcatcgacctgaaagtgaaggagatttccaaccaggaacctcttaaactgtga

SEQ ID NO: 5644 - RNA, 1290 nt, synthetic construct
  misc_feature 1..1290: note = derived and/or modified CDS sequence (opt3) from HTNV(CA10081109)__HQ834500.1__N
  source 1..1290: mol_type = other RNA
atgcccaccagcggcgagctgcagagagaaatcaacgcccacgaggggcaactcgtgattgctaggcagaaggtccgggacgcagaaaagcagtacgagaaggatcctgacgaacttaataaacgcgccctgacagatcgagagggagttgcggcttccatacaggccaagatcgacgagttgaaacgtcaattagcagatagaattgccactggtaagaacctgggcaaggaacaggacccaacgggggtggagccgggagatcatctaaaagaaaggtctatgctctcatatggcaatgtactggaccttaaccacctggatatcgacgagcccaccggtcagacagctgattggttgagtattgtgatctacctcactagcttcgtcgtgcctatactgctgaaggcactctatatgttaaccacacgggggcgccagaccactaaagacaataagggaacaagaatcaggtttaaagatgactcctctttcgaggacgttaacggcattcggaagccaaagcatctgtacgtgtcgcttcccaatgcccaatcaagcatgaaagctgaagagatcacccctggccgctatcgaacggccatttgcgaattgtacccagcgcagatcaaggcaagtaaaatgatatcccccgtcatgtctgtgattgggtttctggccctagctaaggattggagcgacagaatcgagcagtggctctccgaaccttgtaaactgcttccagatactgccgcagtatcactgcacggaggtccggctaccaacagggactatttgcggcagcgtcaagttgccctcggcaatatggagacaaaggagagtaaagcgattcgccagcatgccgaaagcgcagggtgctctatggtggaggatatcgaatccccctcaagcatctgggtcttcgctggagcccctgacagatgtccacccacttgcctgtttattgctggcatagccgagttaggtgcattctttagtatcctgcaggatatgaggaacaccattatggcctctaagacagtggggacctccgaagagaagctccggaaaaagagctcgttctaccaatcttaccttcgacgcacgcagtccatgggaatccagctggaccagagaataattgtgttgtttatggtcgcttggggcaaagaggcggttgataatcctcacgcaggcgacgatgtggacccatcactagggatgctggcccaaagtctcatcgacgtaaaggtgaaagaaatcagcaaccaggagcccctgaaactttga

SEQ ID NO: 5645 - RNA, 1290 nt, synthetic construct
  misc_feature 1..1290: note = derived and/or modified CDS sequence (opt3) from HTNV(CA10081113)__HQ834501.1__N
  source 1..1290: mol_type = other RNA
atggccaccagcggcgagctgcagagagaaatcaacgctcacgaggggcaactcgtgattgcaaggcagaaggtccgggacgccgaaaaacagtacgagaaggatcccgacgaacttaataaacgcgcgctgacagatcgagagggagttgctgcctccatacaggcaaagatcgacgagttgaaacgtcaattagccgatagaattgctactggtaagaacctgggcaaggaacaggaccctacgggggtggagccaggagatcatctaaaagaaaggtctatgctctcatatggcaatgtactggaccttaaccacctggatatcgacgagccgaccggtcagacagcagattggttgagtattgtgatctacctcactagcttcgtcgtgcccatactgctgaaggccctctatatgttaaccacacgggggcgccagaccactaaagacaataagggaacaagaatcaggtttaaagatgactcctctttcgaggacgttaacggcattcggaagcctaagcatctgtacgtgtcgcttccaaatgctcaatcaagcatgaaagccgaagagatcacccccggccgctatcgaacggcgatttttgaattgtaccctgcacagatcaaggccagacagatgataagtccagtcatgtccgtgattgggttcctggctctagccaaagattggtctgacaggatcgagcagtggctcagcgaaccctgcaagctgcttcctgatactgcagctgtatccctgcacggaggtccagccaccaaccgggactatttgcgtcaacgccaggttgcgctcggcaatatggagacaaaagagtcaaaggccattagacagcatgcagaaagtgctgggtgtagcatggtggaggatatcgaatctccgtcctcaatctgggtctttgccggagctcccgacaggtgccctccaacttgtctgttcattgccggcatagcagagttaggtgcctttttcagcatcctgcaagatatgcggaacaccattatggctagtaaaacagtggggacctctgaagagaagctccgaaagaaatccagcttttaccagtcgtaccttcgcagaacgcagtctatgggaatccagctggaccaaaggataattgtgttgttcatggtcgcgtggggcaaggaggcagttgataatcggcacctaatgaacatcgtggaccccgaacctcgcgccctggctcagtccctcatcgatgtaaaagtgaaggagatttcaaatcaggaaccactgaaactttga

SEQ ID NO: 5646 - RNA, 1290 nt, synthetic construct
  misc_feature 1..1290: note = derived and/or modified CDS sequence (opt3) from HTNV(CA10081203)__HQ834502.1__N
  source 1..1290: mol_type = other RNA
atggccaccaacggcgagctgcagagagaaatcaatgctcacgaggggcaactcgtgattgcaaggcagaaggtccgggacgccgaaaaacagtacgagaaggatcccgacgaacttaacaaacgcgcgctgacagatcgagagggagttgctgccagcatacaggcaaagatcgacgagttgaaacgtcaattagccgatagaattgctactggtaagaatctgggcaaggaacaggaccctacgggggtggagccaggagatcatctaaaagaaaggtccatgctctcttatggcaacgtactggaccttaatcacctggatatcgacgagccgaccggtcagacagcagattggttgtcaattgtgatctacctcaccagtttcgtcgtgcccatactgctgaaggccctctatatgttaactacacgggggcgccagaccactaaagacaacaagggaacaagaatcaggtttaaagatgacagctccttcgaggacgttaatggcattcggaagcctaagcatctgtacgtgtctcttccaaacgctcaatcgtcaatgaaagccgaagagatcacccccggccgctatcgaacggcgatttttgggttgtaccctgcacagatcaaggccagacagatgataagcccagtcatgagtgtgattggattcctggctctagccaaagattggtccgacaggatcgaacagtggctctctgagccctgcaagctgcttcctgatactgcagctgtaagcctgcacggtggcccagccaccaatcgggactatttgcgtcaacgccaggttgcgctcgggaacatggaaacaaaagagtccaaggccattagacagcatgcagagtcagctggatgtagtatggtggaagatatcgagagcccgtcttccatctgggtctttgccggcgctcccgacaggtgccctccaacttgtctgttcattgccggtatagcagaattaggggcctttttctcaatcctgcaagatatgcggaataccattatggctagcaaaacagtgggaaccagtgaggaaaagctccgaaagaaatcttccttttaccagagctaccttcgcagaacgcagtcgatgggcatccagctggaccaaaggataattgtgttgttcatggtcgcgtggggcaaggaggcagttgatgagctacactctggggacggagaacaccatgcctcccggactctggctcagtcactcatcgatgtgaaagtaaaggagatcagtaaccaggaacccctgaaactttga

SEQ ID NO: 5647 - RNA, 1290 nt, synthetic construct
  misc_feature 1..1290: note = derived and/or modified CDS sequence (opt3) from HTNV(CA10081206)__HQ834503.1__N
  source 1..1290: mol_type = other RNA
atggccaccatcgaggaactgcagagagagattaacgctcacgaaggccaactcgtgatagcaaggcagaaggtccgggacgccgagaaacagtacgaaaaggatcccgacgagcttaataaacgcgcgctgacagatcgagagggggttgctgccagcatccaggcaaagattgacgaattgaaacgtcaattagccgatagaatcgctactggaaagaacctgggtaaggagcaggaccctacgggcgtggaaccaggggatcatctaaaagagaggtccatgctctcttatggaaatgtactggaccttaaccacctggatattgacgagccgaccggccagacagcagattggttgtcaatcgtgatatacctcaccagtttcgtcgtgcccatcctgctgaaggccctctatatgttaactacacggggtcgccagaccactaaagacaataaggggacaagaattaggtttaaagatgacagctccttcgaagacgttaacggaatccggaagcctaagcatctgtacgtgtctcttccaaatgctcaatcgtcaatgaaagccgaggaaattacccccggccgctatcgaacggcgatctgcggcttgtaccctgcacagataaaggccagacagatgattagcccagtcatgagtgtgatcgggtttctggctctagccaaagattggtccgacaggattgagcagtggctctctgaaccctgtaagctgcttcctgatactgcagctgtaagcctgcacggaggtccagccaccaaccgggactatttgcgtcaacgccaggttgcgctcggcaatatggagacaaaagagtccaaggccatcagacagcatgcagaatcagctgggtgcagtatggtggaggatatcgaaagcccgtcttccatttgggtcttcgccggagctcccgacaggtgtcctccaacttgcctgtttatagccggcatcgcagagttaggtgccttcttttcaattctgcaagatatgcggaacaccatcatggctagcaaaacagtggggaccagtgaagagaagctccgaaagaaatcttccttctaccagagctaccttcgcagaacgcagtcgatgggaatacagctggaccaaaggattatcgtgttgtttatggtcgcgtggggcaaggaggcagttgataatttccacgcctgggacggcatggatcccgaactacggactctggctcagtctctcatcgacgtgaaagtaaaggagatttccaaccaggaacctctgaaactttga

SEQ ID NO: 5648 - RNA, 1290 nt, synthetic construct
  misc_feature 1..1290: note = derived and/or modified CDS sequence (opt3) from HTNV(CA10081708)__HQ834504.1__N
  source 1..1290: mol_type = other RNA
atgcccaccagcggcgagctgcagagagaaatcaacgcccacgaggggcaactcgtgattgctaggcagaaggtccgggacgcagaaaaacagtacgagaaggatcctgacgaacttaataaacgcgccctgacagatcgagagggagttgcggcttccatacaggccaagatcgacgagttgaaacgtcaattagcagatagaattgccactggtaagaacctgggcaaggaacaggacccaacgggggtggagccgggagatcatctaaaagaaaggtctatgctctcatatggcaatgtactggaccttaaccacctggatatcgacgagcccaccggtcagacagctgattggttgagtattgtgatctacctcactagcttcgtcgtgcctatactgctgaaggcactctatatgttaaccacacgggggcgccagaccactaaagacaataagggaacaagaatcaggtttaaagatgactcctctttcgaggacgttaacggcattcggaagccaaagcatctgtacgtgtcgcttcccaatgcccaatcaagcatgaaagctgaagagatcacccctggccgctatcgaacggccatttttgaattgtacccagcgcagatcaaggcaagaaaaatgataagtcccgtcatgtccgtgattgggttcctggccctagctaaggattggtctgacaggatcgagcagtggctcagcgaaccttgcaaactgcttccagatactgccgcagtatccctgcacggaggtccggctaccaaccgggactatttgcgtcagcgccaagttgccctcggcaatatggagacaaaggagtcaaaagcgattagacagcatgccgaaagtgcagggtgtagcatggtggaggatatcgaatctccctcctcaatctgggtctttgctggagcccctgacaggtgcccacccacttgtctgttcattgctggcatagccgagttaggtgcatttttcagcatcctgcaggatatgcggaacaccattatggccagtaagacagtggggacctctgaagagaagctccgaaagaagtccagcttttaccaatcgtaccttcgcagaacgcagtctatgggaatccagctggaccagaggataattgtgttgttcatggtcgcttggggcaaagaggcggttgataatcctcacactggcgacgatgcagacccagaactacggacactggcccaatccctcatcgacgtgaaggtaaaagagatctcaaaccaggaacccctgaaactttga

SEQ ID NO: 5649 - RNA, 1290 nt, synthetic construct
  misc_feature 1..1290: note = derived and/or modified CDS sequence (opt3) from HTNV(CA10081905)__HQ834505.1__N
  source 1..1290: mol_type = other RNA
atggccaccagcggcgagctgcagagagaaatcaacgctcacgaggggcaactcgtgattgcaaggcagaaggtccgggacgccgaaaaacagtacgagaaggatcccgacgaacttaataaacgcgcgctgacagatcgagagggagttgctgcctccatacaggcaaagatcgacgagttgaaacgtcaattagccgatagaattgctactggtaagaacctgggcaaggaacaggaccctacgggggtggagccaggagatcatctaaaagaaaggtctatgctctcatatggcaatgtactggaccttaaccacctggatatcgacgagccgaccggtcagacagcagattggttgagtattgtgatctacctcactagcttcgtcgtgcccatactgctgaaggccctctatatgttaaccacacgggggcgccagaccactaaagacaataagggaacaagaatcaggtttaaagatgactcctctttcgaggacgttaacggcattcggaagcctaagcatctgtacgtgtcgcttccaaatgctcaatcaagcatgaaagccgaagagatcacccccggccgctatcgaacggcgatttttgaattgtaccctgcacagatcaaggccagaaaaatgataagtccagtcatgtccgtgattgggttcctggctctagccaaggattggtctgacaggatcgagcagtggctcagcgaaccctgcaaactgcttcctgatactgcagctgtatccctgcacggaggtccagccaccaaccgggactatttgcgtcagcgccaagttgcgctcggcaatatggagacaaaggagtcaaaagccattagacagcatgcagaaagtgctgggtgtagcatggtggaggatatcgaatctccgtcctcaatctgggtctttgccggagctcccgacaggtgccctccaacttgtctgttcattgccggcatagcagagttaggtgcctttttcagcatcctgcaggatatgcggaacaccattatggctagtaagacagtggggacctctgaagagaagctccgcaaaaagtccagcttttaccaatcgtaccttcgaagaacgcagtctatgggaatccagctggaccagaggataattgtgttgttcatggtcgcgtggggcaaagaggcagttgataatcaccacctaatcaacgccggcgaccatgaactgcggactctcgctcaatccctgatcgatgtgaaggtaaaagagatttcaaatcaggaaccccttaagctgtga

SEQ ID NO: 5650 - RNA, 1290 nt, synthetic construct
  misc_feature 1..1290: note = derived and/or modified CDS sequence (opt3) from HTNV(E142)__AF288644.1__N
  source 1..1290: mol_type = other RNA
atggccaccatggaggaactgcagagagagatcaacgctcacgaaggccaactcgtgattgcaaggcagaaggtccgggacgccgagaaacgctacgaaaaggatcccgacgagcttaataaacgaacactgactgatcgtgagggggttgcggctagcatacaggccaagatcgacgaattgaaaagacagttagcagataggattgccacgggaaagaacctgggtaaggagcaagaccctaccggcgtggaaccaggggatcatctaaaagagcggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccgcggtagacagactacaaaagacaataaggggaccaggatccggtttaaagatgacagctcctctgaagacgttaacggcattcgcaagcctaagcatctgtacgtgtcgcttccaaatgcccagtcaagcatgaaagctgaggaaatcacgcccggacgatatagaactgccatttgcggcttgtaccctgcgcaaatcaaggcaaggcagatgataagtccagtcatgtccgtgattgggttcctggccctagctaaagattggtctgaccggatcgagcagtggctcagcgaaccctgtaagctgcttcctgataccgccgcagtatccctgcacggaggtccagctacaaaccgtgactatttgcgccagagacaagttgccctcggcaatatggagactaaagagtcaaaggcgattaggcagcatgccgaaagtgcagggtgcagcatgatcgaggatatcgaatctccgtcctcaatttgggtgtttgctggagcccccgaccggtgtcctccaacctgcctgttcatagctggcatcgccgagttaggtgcatttttcagcattctgcaggatatgcgaaacacaatcatggccagtaaaaccgtcgggacgtctgaagagaagctccgcaagaaatccagcttttaccaatcgtaccttagaaggactcagtctatgggaatacagctggaccagcggattatcgtgttgttcatggtggcttggggcaaggaggtcgttgataattttcacctaggcgacgatatggaccccgaactgcgcacactcgcgcaatccctgatcgacgtgaaagtaaaggagatttcaaaccaggaacctcttaaactgtga

SEQ ID NO: 5651 - RNA, 1290 nt, synthetic construct
  misc_feature 1..1290: note = derived and/or modified CDS sequence (opt3) from HTNV(H10150)__HQ834506.1__N
  source 1..1290: mol_type = other RNA
atggccaccatgggcgagctgcagagagaaatcaacgctcacgaggggcaactcgtgattgcaaggcagaaggtccgggacgccgaaaaacagtacgagaaggatcccgacgaacttaataaacgcgcgctgacagatcgagagggagttgctgccagcatacaggcaaagatcgacgagttgaaacgtcaattagccgatagaattgctactggtaagaacctgggcaaggaacaggaccctacgggggtggagccaggagatcatctaaaagaaaggtccatgctctcttatggcaatgtactggaccttaaccacctggatatcgacgagccgaccggtcagacagcagattggttgtcaattgtgatctacctcaccagtttcgtcgtgcccatactgctgaaggccctctatatgttaactacacgggggcgccagaccactaaagacaataagggaacaagaatcaggtttaaagatgacagctccttcgaggacgttaacggcattcggaagcctaagcatctgtacgtgtctcttccaaatgctcaatcgtcaatgaaagccgaagagatcacccccggccgctatcgaacggcgatttttgggttgtaccctgcacagatcaaggccagacagatgataagcccagtcatgagtgtgattggattcctggctctagccaaagattggtccgacaggatcgaacagtggctctctgagccctgcaagctgcttcctgatactgcagctgtaagcctgcacggtggcccagccaccaaccgggactatttgcgtcaacgccaggttgcgctcgggaatatggaaacaaaagagtccaaggccattagacagcatgcagagtcagctggatgtagtatggtggaagatatcgagagcccgtcttccatctgggtctttgccggcgctcccgacaggtgccctccaacttgtctgttcattgccggtatagcagaattaggggcctttttctcaatcctgcaagatatgcggaacaccattatggctagcaaaacagtgggaaccagtgaggaaaagctccgaaagaaatcttccttttaccagagctaccttcgcagaacgcagtcgatgggcatccagctggaccaaaggataattgtgttgttcatggtcgcgtggggcaaggaggcagttgataatcaccactgggccaacgctatcgggtctgagctacggactctggcccagtccctcatcgacgtgaaagtaaaggaaatttcaaatcaggagcccctgaaactttga

SEQ ID NO: 5652 - RNA, 1290 nt, synthetic construct
  misc_feature 1..1290: note = derived and/or modified CDS sequence (opt3) from HTNV(Aa03-161)__KT935024.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccgtatgcggcttgtaccctgcgcagatcaaggcaagacagatgattagcccagttatgagtgtgatcgggtttctggccctagctaaagattggtccgacaggatagagcagtggctctctgaaccctgtaagctgcttcctgatgccgcagctgtcagcctgttgggaggtccagccactaaccgggactatctccgtcaacgccaggtggcgctgggcaatatggagaccaaagagtccaaggccattagacagcacgcagaagctgccgggtgctcaatgatcgaggatattgaaagtccgagctctatctgggtgttcgctggagcccccgacaggtgtcctccaacatgcttatttatcgcaggcattgccgagctgggtgctttcttttccatactccaagatatgcggaacactatcatggcgtcaaaaaccgtcgggacaagcgaagagaaacttcgaaagaagagttctttctaccagtcctacctgcgcagaacccagagcatgggcattcagttggaccaaaggatcatagttctatttatggtggcatggggaaaggaggccgtagataatttccatctgggcgacgatatggaccccgaactccggacgctggctcagtcgcttattgacgtgaaagtcaaggagatctctaaccaggaacctctgaaattgtga

SEQ ID NO: 5653 - RNA, 1290 nt, synthetic construct
  misc_feature 1..1290: note = derived and/or modified CDS sequence (opt3) from HTNV(Aa04-722)__KU207190.1__N
  source 1..1290: mol_type = other RNA
atggccaccatggaggaactgcagagagagatcaacgctcacgaaggccaactcgtgattgcaaggcagaaggtccgggacgccgagcgccagtacgaaaaagatcccgacgagcttaataagcgagcgctgacagatcgtgagggggttgctgtgagcatacaggccaaaatcgacgaattgaagagacaattagcagataggattgccactggtaaaaacctgggaaaggagcaggaccctacgggcgtagaaccaggggatcatctaaaggagcggtccatgctctcttatggaaatgtgctggaccttaaccacctggatatcgacgagccgaccggccagacagctgattggttgtcaattgtcgtgtacctcaccagtttcgttgtgcccatcctgctgaaagcactctatatgttaactacacgcggtagacagaccactaaggacaataaagggacaaggatacggtttaaggatgacagctccttcgaagacgtcaacggaatccgcaaacctaagcatctgtacgtgtctcttccaaatgcccaatcgtcaatgaaggctgaggaaattacccccggccgatatagaacggccgtatgcggcttgtaccctgcgcagatcaaagcaaggcagatgattagcccagttatgagtgtgatcgggtttctggccctagctaaggattggtccgaccggatagagcagtggctctctgaaccctgtaaactgcttcctgatactgccgcagtcagcctgttgggaggtccagctaccaaccgtgactatctccgccaaagacaggtggccctgggcaatatggagacaaaggagtccaaagcgattaggcagcacgccgaagcagctgggtgctcaatgatcgaggatattgaaagtccgagctctatctgggtgttcgccggagctcccgaccggtgtcctccaacttgcttatttatcgccggcattgcagagctgggtgccttcttttccatactccaagatatgcgaaacaccatcatggcttcaaagacagtcgggaccagcgaagagaaacttcgcaagaagagttctttctaccagtcctacctgagaaggacgcagagcatgggcattcagttggaccaacggatcatagttctatttatggtggcgtggggaaaagaggcagtagataatttccatctgggcgacgatatggaccccgaactccgcactctggcccagtcgcttattgacgtgaaggtcaaagagatctctaaccaggaacctctgaagttgtga

SEQ ID NO: 5654 - RNA, 1290 nt, synthetic construct
  misc_feature 1..1290: note = derived and/or modified CDS sequence (opt3) from HTNV(Aa05-190)__KT935027.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccgtatgcggcttgtaccctgcgcagatcaaggcaagacagatgattagcccagttatgagtgtgatcgggtttctggccctagctaaagattggtccgacaggatagagcagtggctctctgaaccctgtaagctgcttcctgatactgccgcagtcagcctgttgggaggtccagctaccaaccgggactatctccgtcaacgccaggtggccctgggcaatatggagacaaaagagtccaaggcgattagacagcacgccgaagcagctgggtgctcaatgatcgaggatattgaaagtccgagctctatctgggtgttcgccggagctcccgacaggtgtcctccaacttgcttatttatcgccggcattgcagagctgggtgccttcttttccatactccaagatatgcggaacaccatcatggcttcaaaaacagtcgggaccagcgaagagaaacttcgaaagaagagttctttctaccagtcctacctgcgcagaacgcagagcatgggcattcagttggaccaaaggatcatagttctatttatggtggcgtggggaaaggaggcagtagataatttccatctgggcgacgatatggaccccgaactccggactctggcccagtcgcttattgacgtgaaagtcaaggagatctctaaccaggaacctctgaaattgtga

SEQ ID NO: 5655 - RNA, 1290 nt, synthetic construct
  misc_feature 1..1290: note = derived and/or modified CDS sequence (opt3) from HTNV(Aa10-123)__KT935036.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccgtatgcggcttgtaccctgcgcagatcaaggcaagacagatgattagcccagttatgagtgtgatcgggtttctggccctagctaaagattggtccgacaggatagagcagtggctctctgaaccctgtaagctgcttcctgatactaccgccgtcagcctgttgggaggtccagcaacaaaccgggactatctccgtcaacgccaggtggctctgggcaatatggagactaaagagtccaaggccattagacagcacgcggaagccgcagggtgctcaatgatcgaggatattgaaagtccgagctctatctgggtgttcgctggagcccccgacaggtgtcctccaacctgcttatttgtcgctggcatcgccgagctgggtgcattcttttccattctccaagatatgcggaacacaataatggcctcaaaaaccgttgggacgagcgaagagaaacttcgaaagaagagttctttctaccagtcctacctgcgcagaactcagagcatgggaatccagttggaccaaaggattatcgtgctatttatggtagcttggggcaaggaggcggtggataatttccatctgggcgacgatatggaccccgaactccggacactggcacagtcgcttatagacgtcaaagtgaaggagatttctaaccaggaacctctgaaattgtga

SEQ ID NO: 5656 - RNA, 1290 nt, synthetic construct
  misc_feature 1..1290: note = derived and/or modified CDS sequence (opt3) from HTNV(Aa10-265)__KU207194.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccgtatgcggcttgtaccctgcgcagatcaaggcaagacagatgattagcccagttatgagtgtgatcgggtttctggccctagctaaagattggtccgacaggatagagcagtggctctctgaaccctgtaagctgcttcctgatactgccgcagtcagcctgttgggaggtccagctaccaaccgggactatctccgtcaacgccaggtggccctgggcaatatggagacaaaagagtccaaggcgattagacagcacgccgaagcagctgggtgctcaatgatcgaggatattgaaagtccgagctctatctgggtgttcgccggagctcccgacaggtgtcctccaacttgcttatttgtcgccggcatcgcagagctgggtgccttcttttccattctccaagatatgcggaacaccataatggcttcaaaaacagttgggaccagcgaagagaaacttcgaaagaagagttctttctaccagtcctacctgcgcagaacgcagagcatgggaatccagttggaccaaaggattatcgtgctatttatggtagcgtggggcaaggaggcagtggataatttccatctgggcgacgatatggaccccgaactccggactctggcccagtcgcttatagacgtcaaagtgaaggagatttctaaccaggaacctctgaaattgtga

SEQ ID NO: 5657 - RNA, 1290 nt, synthetic construct
  misc_feature 1..1290: note = derived and/or modified CDS sequence (opt3) from HTNV(AA1028)__AF427318.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccatctgcggcttgtaccctgcgcagattaaggcaagacagatgatcagcccagtaatgagtgttatagggtttctggccctagctaaagattggtccgacaggattgagcagtggctctctgaaccctgtaagctgcttcctgatactgccgcagtgagcctgttgggaggtccagctaccaaccgggactatctccgtcaacgccaggtcgccctgggcaatatggagacaaaagagtccaaggcgatcagacagcacgccgaagcagctgggtgctcaatgattgaggatatcgaaagtccgagctctatctgggtgttcgccggagctcccgacaggtgtcctccaacttgcttatttattgccggcatagcagagctgggtgccttcttttccatcctccaagatatgcggaacaccattatggcttcaaaaacagtggggaccagcgaagagaaacttcgaaagaagagttctttctaccagtcctacctgcgcagaacgcagagcatgggaatccagttggaccaaaggataattgtcctatttatggttgcgtggggcaaggaggcagtggataatttccatctgggcgacgatatggaccccgaactccggactctggcccagtcgcttatcgacgtaaaagtgaaggagatctctaaccaggaacctctgaaattgtga

SEQ ID NO: 5658 - RNA, 1290 nt, synthetic construct
  misc_feature 1..1290: note = derived and/or modified CDS sequence (opt3) from HTNV(Aa10-434)__KT935038.1__N
  source 1..1290: mol_type = other RNA
atggccaccatggaggaactgcagagagagatcaacgctcacgaaggccaactcgtgattgcaaggcagaaggtccgggacgccgagaaacagtacgggaaggatcccgacgaacttaataaacgcgcgctgacagatcgagagggagttgctgtgagcatacaggccaagatcgacgagttgaaacgtcaattagcagatagaattgccactggtaagaacctgggcaaggaacaggaccctacgggggtagagccaggagatcatctaaaagaaaggtccatgctctcttatggcaatgtgctggaccttaaccacctggatatcgacgagccgaccggtcagacagctgattggttgtcaattgtcgtgtacctcaccagtttcgttgtgcccatcctgctgaaggcactctatatgttaactacacgggggcgccagaccactaaagacaataagggaacaagaataaggtttaaagatgacagctccttcgaggacgtcaacggcatccggaagcctaagcatctgtacgtgtctcttccaaatgcccaatcgtcaatgaaagctgaagagattacccccggccgctatcgaacggccgtatgcgggttgtaccctgcgcagatcaaggcaagacagatgattagcccagttatgagtgtgatcggatttctggccctagctaaagattggtccgacaggatagaacagtggctctctgagccctgtaagctgcttcctgatactgccgcagtcagcctgttgggtggcccagctaccaaccgggactatctccgtcaacgccaggtggccctggggaatatggaaacaaaagagtccaaggcgattagacagcacgccgaggcagctggatgctcaatgatcgaagatattgagagtccgagctctatctgggtgttcgccggcgctcccgacaggtgtcctccaacttgcttatttatcgccggtattgcagaactgggggccttcttttccatactccaagatatgcggaacaccatcatggcttcaaaaacagtcggaaccagcgaggaaaaacttcgaaagaagagttctttctaccagtcctacctgcgcagaacgcagagcatgggcattcagttggaccaaaggatcatagttctatttatggtggcgtggggcaaggaggcagtagataatttccatctgggggacgatatggaccccgagctccggactctggcccagtcgcttattgacgtgaaagtcaaggaaatctctaaccaggagcctctgaaattgtga

SEQ ID NO: 5659 - RNA, 1290 nt, synthetic construct
  misc_feature 1..1290: note = derived and/or modified CDS sequence (opt3) from HTNV(Aa14-362)__KT935049.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccgtatgcggcttgtaccctgcgcagatcaaggcaagacagatgattagcccagttatgagtgtgatcgggtttctggccctagctaaagattggtccgacagggtcgagcagtggctctctgaaccctgtaagctgcttcctgatactgccgcagtgagcctgttgggaggtccagctaccaaccgggactatctccgtcaacgccaggtggccctgggcaatatggagacaaaagagtccaaggcgataagacagcacgccgaagcagctgggtgctcaatgattgaggatatcgaaagtccgagctctatttgggtcttcgccggagctcccgacaggtgtcctccaacttgcttatttatcgccggcatcgcagagctgggtgccttcttttccattctccaagatatgcggaacaccataatggcttcaaaaacagttgggaccagcgaagagaaacttcgaaagaagagttctttctaccagtcctacctgcgcagaacgcagagcatgggaatccagttggaccaaaggattatcgtgctatttatggtagcgtggggcaaggaggcagtggataatttccatctgggcgacgatatggaccccgaactccggactctggcccagtcgcttatagacgtcaaagtgaaggagatttctaaccaggaacctctgaaattgtga

SEQ ID NO: 5660 - RNA, 1290 nt, synthetic construct
  misc_feature 1..1290: note = derived and/or modified CDS sequence (opt3) from HTNV(Aa14-404)__KT935052.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccgtatgcggcttgtaccctgcgcagatcaaggcaagacagatgattagcccagttatgagtgtgatcgggtttctggccctagctaaagattggtccgacaggatagagcagtggctctctgaaccctgtaagctgcttcctgatactgccgcagtcagcctgttgggaggtccagctaccaaccgggactatctccgtcaacgccaggtggccctgggcaatatggagacaaaagagtccaaggcgattagacagcacgccgaagcagctgggtgctcaatgatcgaggatattgaaagtccgagctctatctgggtgttcgccggagctcccgacaggtgtcctccaacttgcttatttatcgccggcattgcagagctgggtgccttcttttccatactccaagatatgcggaacaccatcatggcttcaaaaacagtcgggaccagcgaagagaaacttcgaaagaagagttctttctaccagtcctacctgcgcagaacgcagagcatgggcattcagttggaccaaaggatcatagttctatttatggtggcgtggggaaaggaggcagtagataatttccatctgggcgacgatatggaccccgaactccggactctggcccagtcgcttattgacgtgaaagtcaaggagatctcttcccaggaacctctgaaattgtga

SEQ ID NO: 5661 - RNA, 1290 nt, synthetic construct
  misc_feature 1..1290: note = derived and/or modified CDS sequence (opt3) from HTNV(Aa15-56)__KU207195.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccgtatgcggcttgtaccctgcgcagatcaaggcaagacagatgattagcccagttatgagtgtgatcgggtttctggccctagctaaagattggtccgacaggatagagcagtggctcaacgaaccctgtaagctgcttcctgatactgccgcagtctctctgttgggaggtccagctaccaatcgggactatctccgtcaacgccaggtggccctgggcaacatggagacaaaagagagcaaggcgattagacagcacgccgaagcagctgggtgctccatgatcgaggatattgaatcaccgagtagcatctgggtgttcgccggagctcccgacaggtgtcctccaacttgcttatttatcgccggcattgcagagctgggtgccttcttttctatactccaagatatgcggaataccatcatggcttccaaaacagtcgggacctcagaagagaagctgcgaaagaaaagcagtttctaccagtcttaccttcgcagaacgcagtccatgggcattcagttggaccaaaggatcatagttctatttatggtggcgtggggaaaggaggcagtagataacttccatctgggcgacgatatggaccccgaactccggactctggcccagagccttattgacgtgaaagtcaaggagatctcgaatcaggaacctctgaaattgtga

SEQ ID NO: 5662 - RNA, 1290 nt, synthetic construct
  misc_feature 1..1290: note = derived and/or modified CDS sequence (opt3) from HTNV(AA1719)__AF427319.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccatctgcggcttgtaccctgcgcagattaaggcaagacagatgatcagcccagtaatgagtgttatagggtttctggccctagctaaagattggtccgacaggattgagcagtggctctctgaaccctgtaagctgcttcctgatactgccgcagtgagcctgttgggaggtccagctaccaaccgggactatctccgtcaacgccaggtcgccctgggcaatatggagacaaaagagtccaaggcgatcagacagcacgccgaagcagctgggtgctcaattatcgaggatatcgaaagtccgagctctatttgggtgttcgccggagctcccgacaggtgtcctccaacttgcttatttatagccggcatcgcagagctgggtgccttcttttccattctccaagatatgcggaacaccatcatggcttcaaaaacagtggggaccagcgaagagaaacttcgaaagaagagttctttctaccagtcctacctgcgcagaacgcagagcatgggaatacagttggaccaaaggattatcgtcctatttatggttgcgtggggcaaggaggcagtggataatttccatctgggcgacgatatggaccccgaactccggactctggcccagtcgcttatcgacgtaaaagtgaaggagatttctaaccaggaacctctgaaattgtga

SEQ ID NO: 5663 - RNA, 1290 nt, synthetic construct
  misc_feature 1..1290: note = derived and/or modified CDS sequence (opt3) from HTNV(AP1168)__AF427323.1__N
  source 1..1290: mol_type = other RNA
atggccaccatggaggaactgcagaaggagatcaacgctcacgaaggccaactcgtgattgcaagacagaaagtcagggacgccgagcggcagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtggtctacctcaccagtttcgtggttcccatcctgctgaaggccctctatatgttaactacacggggtcgccagaccactaaagacaataaggggacaagaataaggtttaaagatgacagctccttcgaagacgtgaacggaatccggaagcctaagcatctgtacgtctctcttccaaatgctcaatcgtcaatgaaagccgaggaaattacccccggccgctatcgaacggcgatctgcggcttgtaccctgcacagattaaggccagacagatggtgagcccagtaatgagtgttatcgggtttctggctctagccaaagattggggagacaggatagagcagtggctctccgaaccctgtaagctgcttcctgatactgcagctgtgtctctgcacggtggcccagccaccaaccgggactatttgcgtcaacgccaggcggccctcgggaatatggagacaaaagagagcaaggcaattagacagcatgctgaaactgccggatgctccatgatcgaggatattgaatcaccgagtagcatctgggtcttcgctggcgcccccgacaggtgtcctccaacctgcctgtttatcgcaggtattgccgagttaggggctttcttttctatactgcaagatatgcggaacacaatcatggcgtccaaaaccgtgggaacgtcagaagagaagctccgaaagaaaagcagtttctaccagtcttaccttcgcagaactcagtccatgggcattcagctggaccaaaggatcatagtgttgtttatggtcgcatggggcaaggaggccgttgataatttccacctaggggacgatatggaccccgaactgcggacactcgctcagagcctgattgaccttaaagtgaaggagatctcgaaccaggaacctctgaaattgtga

SEQ ID NO: 5664 - RNA, 1290 nt, synthetic construct
  misc_feature 1..1290: note = derived and/or modified CDS sequence (opt3) from HTNV(AP708)__AF427322.1__N
  source 1..1290: mol_type = other RNA
atggccaccatggaggaactgcagaaggagatcaacgctcacgaaggccaactcgtgattgcaagacagaaagtcagggacgccgagcggcagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtggtctacctcaccagtttcgtggttcccatcctgctgaaggccctctatatgttaactacacggggtcgccagaccactaaagacaataaggggacaagaataaggtttaaagatgacagctccttcgaagacgtgaacggaatccggaagcctaagcatctgtacgtctctcttccaaatgctcaatcgtcaatgaaagccgaggaaattacccccggccgctatcgaacggcgatctgcggcttgtaccctgcacagattaaggccagacagatggtgagcccagtaatgagtgttatcgggtttctggctctagccaaagattggggagacaggatagagcagtggctctccgaaccctgtaagctgcttcctgatactgcagctgtgtctctgcacggtggcccagccaccaaccgggactatttgcgtcaacgccaggcggccctcgggaatatggagacaaaagagagcaaggcaattagacagcatgctgaaactgccggatgctccatgatcgaggatattgaatcaccgagtagcgtctgggtgttcgctggcgcccccgacaggtgtcctccaacctgcctgtttatcgcaggtatcgccgagttaggggctttcttttctattctgcaagatatgcggaacacaataatggcgtccaaaaccgtgggaacgtcagaagagaagctccgaaagaaaagcagtttctaccagtcttaccttcgcagaactcagtccatgggcatccagctggaccaaaggattatcgtcttgtttatggttgcatggggcaaggaggccgtggataatttccacctaggggacgatatggaccccgaactgcggacactcgctcagagcctgatagaccttaaagtaaaggagatttcgaaccaggaacctctgaaattgtga

SEQ ID NO: 5665 - RNA, 1290 nt, synthetic construct
  misc_feature 1..1290: note = derived and/or modified CDS sequence (opt3) from HTNV(DandongHu-32)__KC570386.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccatctgcggcttgtaccctgcgcagattaaggcaagacagatgatcagcccagtaatgagtgttatagggtttctggccctagctaaagattggtccgacaggattgagcagtggctctctgaaccctgtaagctgcttcctgatactgccgcagtgagcctgttgggaggtccagctaccaaccgggactatctccgtcaacgccaggtcgccctgggcaatatggagacaaaagagtccaaggcgatcagacagcacgccgaagcagctgggtgctcaatgattgaggatatcgaaagtccgagctctatctgggtgttcgccggagctcccgacaggtgtcctccaacttgcttatttattgccggcatagcagagctgggtgccttcttttccatcctccaagatatgcggaacaccattatggcttcaaaaacagtggggaccagcgaagagaaacttcgaaagaagagttctttctaccagtcctacctgcgcagaacgcagagcatgggaatccagttggaccaaaggataattgtcctatttatggttgcgtggggcaaggaggcagtggataatttccatctgggcgacgatatggaccccgaactccggatcctggcccagtcgcttatcgacgtaaaagtgaaggagatttctaaccaggaacctctgaaattgtga

SEQ ID NO: 5666 - RNA, 1290 nt, synthetic construct
  misc_feature 1..1290: note = derived and/or modified CDS sequence (opt3) from HTNV(DandongHu-34)__KC570387.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccatctgcggcttgtaccctgcgcagattaaggcaagacagatgatcagcccagtaatgagtgttatagggtttctggccctagctaaagattggtccgacaggattgagcagtggctctctgaaccctgtaagctgcttcctgatactgccgcagtgagcctgttgggaggtccagctaccaaccgggactatctccgtcaacgccaggtcgccctgggcaatatggagacaaaagagtccaaggcgatcagacagcacgccgaagcagctgggtgctcaatgattgaggatatcgaaagtccgagctctatctgggtgttcgccggagctcccgacaggtgtcctccaacttgcttatttattgccggcatggcagagctgggtgccttcttttccatactccaagatatgcggaacaccatcatggcttcaaaaacagtggggaccagcgaagagaaacttcgaaagaagagttctttctaccagtcctacctgcgcagaacgcagagcatgggcattcagttggaccaaaggatcatagtcctatttatggttgcgtggggaaaggaggcagtggataatttccatctgggcgacgatatggaccccgaactccggactctggcccagtcgcttattgacgtaaaagtgaaggagatctctaaccaggaacctctgaaattgtga

SEQ ID NO: 5667 - RNA, 1290 nt, synthetic construct
  misc_feature 1..1290: note = derived and/or modified CDS sequence (opt3) from HTNV(DandongHu-89)__KC570389.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtgcgtgtctcttccaaatgcccaatcgtcaatgaaagctgaggaaattacccccggccgctaccgaacggccatctgtggcttgtatcctgcgcagattaaggcaagacagatgatcagcccagtaatgagtgttatagggtttctggccctagctaaagattggtccgacaggattgagcagtggctctctgaaccctgcaagctgcttcctgatactgccgcagtgagcctgttgggaggtccagctaccaaccgggactacctccgtcaacgccaggtcgccctgggcaatatggagacaaaagagtccaaggcgatcagacagcacgccgaagcagctgggtgttcaatgattgaggatatcgaaagtccgagctctatctgggtgttcgccggagctcccgacaggtgccctccaacttgtttatttattgccggcatagcagagctgggtgccttcttttccatcctccaagatatgcggaacaccattatggcttcaaaaacagtggggaccagcgaagagaaacttcgaaagaagagttctttctatcagtcctacctgcgcagaacgcagagcatgggaatccagttggaccaaaggataattgtcctatttatggttgcgtggggcaaggaggcagtggataatttccatctgggcgacgatatggaccccgaactccggactctggcccagtcgcttatcgacgtaaaagtgaaggagatctctaaccaggaacctctgaaattgtga

SEQ ID NO: 5668 - RNA, 1290 nt, synthetic construct
  misc_feature 1..1290: note = derived and/or modified CDS sequence (opt3) from HTNV(DandongHu-91)__KC570390.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgggtattgtcatctacctcacttcattcgtggttcccatactgctgaaggcactctatatgttaaccacacgggggcgccagaccactaaagacaataagggaacaagaatcaggtttaaagatgacagtagcttcgaagacgtgaacggcattcggaagcctaagcatctgtacgtctcccttccaaatgcccaatcttcgatgaaagctgaggaaatcacccccggccgctatcgaacggccatttgcgggttgtaccctgcgcagatcaaggcaagacagatgatatcaccagtgatgagcgtaattggatttctggccctagctaaagattggagtgacaggatcgagcagtggctctccgaaccctgtaagctgcttcctgatactgccgcagtttctctgttgggtggcccagctaccaaccgggactatctccgtcaacgccaggtggccctggggaatatggagacaaaagagagcaaggcgattagacagcacgccgaagcagctggatgctccatgatcgaggatatcgaatcaccgagtagcatttgggtcttcgccggcgctcccgacaggtgtcctccaacttgcttatttatagccggtatggcagagctgggggccttcttttctatcctccaagatatgcggaacaccattatggcttccaaaacagtgggaacctcagaagagaagctgcgaaagaaaagcagtttctaccagtcttaccttcgcagaacgcagtccatgggcatccagttggaccaaaggataattgtgctatttatggtcgcgtggggcaaggaggcagttgataatttccatctgggggacgatatggaccccgaactccggactctggcccagagccttatcgacgtgaaagtaaaggagatctcgaaccaggaacctctgaaattgtga

SEQ ID NO: 5669 - RNA, 1290 nt, synthetic construct
  misc_feature 1..1290: note = derived and/or modified CDS sequence (opt3) from HTNV(Fuyuan-Aa-145)__KJ857349.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccatctgcggcttgcaccctgcgcagattaaggcaagacagatgatcagcccagtaatgagtgttatagggtttctggccctagctaaagattggtccgacaggattgagcagtggctctctgaaccctgtaagctgcttcctgatactgccgcagtgagcctgttgggaggtccagctaccaaccgggactacctccgtcaacgccaggtcgccctgggcaatatggagacaaaagagtccaaggcgatcagacagcatgccgaagcagctgggtgctcaatgattgaggatatcgaaagtccgagctctatctgggtgttcgccggagctcccgacaggtgtcctccaacttgcttatttattgccggcatagcagagctgggtgccttcttttccatcctccaagatatgcggaacaccattatggcttcaaaaacagtggggaccagcgaagagaaacttcgaaagaagagttctttctatcagtcctacctgcgcagaacgcagagcatgggaatccagttggaccaaaggataattgtcctatttatggttgcgtggggcaaggaggcagtggataatttccacctgggcgacgatatggaccccgaactccggactctggcccagtcgcttatcgacgtaaaagtgaaggagatctctaaccaggaacctctgaaattgtga

SEQ ID NO: 5670 - RNA, 1290 nt, synthetic construct
  misc_feature 1..1290: note = derived and/or modified CDS sequence (opt3) from HTNV(Fuyuan-Aa-26)__KJ857347.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgcagttcccatcctgctgaaggccctctatatgttaactacacggggtcgccagaccactaaagacaataaggggacaagaataaggtttaaagatgacagctccctggaagacgtgaacggaatccggaagcctaagcatctttacgtctctttgccaaatgctcaatcgtcaatgaaagccgaggaaattacccccggccgctatcgaacggcgatctgcggcctgtaccctgcacagattaaggccagacagatgatcagcccagtgatgagtgtaatagggttcctagctctcgccaaagattggtccgacaggattgagcagtggctgtctgaaccctgtaaacttctgcctgatactgcagctgttagcttgctcggaggtccagccaccaaccgggactatctgcgtcaacgccaggtggcgttaggcaatatggagacaaaggagtccaaggccatcagacagcacgcagaagctgccgggtgctcaatgattgaggatatcgaaagtccgagctctatctgggtctttgctggagcccccgacaggtgtcctccaacttgccccttcattgcaggcatagccgagctgggtgcgtttttctccatcctccaagatatgcggaacaccattatggcttcaaaaacagtggggaccagcgaagagaaacttcgaaagaagagttctttttaccagtcctacctgcgcagaacgcagagcatgggaatccagttggaccaaaggataattgtgctattcatggtcgcatggggcaaggaggccgttgataattttcatctgggcgacgatatggaccctgaactccggactctggctcagtcgcttatcgacgtgaaagtaaaggagatctctaaccaggaaccactgaaattgtga

SEQ ID NO: 5671 - RNA, 1290 nt, synthetic construct
  misc_feature 1..1290: note = derived and/or modified CDS sequence (opt3) from HTNV(JS1)__KP970572.1__N
  source 1..1290: mol_type = other RNA
atggccaccatggaggaactgcagagagagatcaacgctcacgaaggccaactcgtgattgcaaggcagaaggtccgggacgccgagaaacagtacgaaaatgatcccgacgagcttaacaagcgcgcgctgacaaatcgagagggggttgctgtgagcatacaggccaaaatcgatgaattgaagcgtcaattagcagacagaattgccactggaaagaacctgggtaaggagcaggatcctacgggcgtagaaccaggggaccatctaaaggagaggtccatgctctcttatggaaatgtgctggatcttaaccacctggacatcgatgagccgaccggccagacagctgactggttgtcaattatcgtctacctcaccagtttcgtggttcccatactgctgaaagcactctatatgttaactacacggggtcgccagaccactaaggataataaagggacaagaatcaggtttaaggacgatagctccttcgaagacgtgaacggcattcggaaacctaagcatctgtacgtctctcttccaaatgcccaatcgtcaatgaaggctgaggaaatcacccccggacgctatcgaacggccgtgtgcggcttgtaccctgcgcagattaaagcaagacagatgatcagcccagtaatgagtgttatagggtttctggccctagctaaggactggtccgataggattgagcagtggctcatcgaaccctgtaaactgcttcctgacactgccgcagtgtctctgttgggaggtccagctaccaaccgggattatctccgtcaacgccaggtcgccctgggcaatatggagacaaaggagagcaaagcgattagacagcacgccgaagcagctgggtgctccatgatcgaggacatcgaatcaccgagtagcatttgggtgttcgccggagctcccgataggtgtcctccaacttgcttatttatagccggcatcgcagagctgggtgccttcttttctattctccaagacatgcggaacaccatcatggcttccaagacagtggggacctcagaagagaaacttcgaaagaaaagcagtttctaccagtcttacctgcgcagaacgcagtccatgggaatacagttggatcaaaggattatcgtcctatttatggttgcgtggggcaaagaggcagtggacaatttccatctgggcgatgacatggatcccgaactccggactctggcccagagccttatcgacgtaaaggtgaaagagatttcgaaccaggaacctctgaagttgtga

SEQ ID NO: 5672 - RNA, 1290 nt, synthetic construct
  misc_feature 1..1290: note = derived and/or modified CDS sequence (opt3) from HTNV(LongquanAa-08-150)__JQ912697.1__N
  source 1..1290: mol_type = other RNA
atggccaccatggaggaactgcagagagagatcgacgctcacgaaggccaactcgtgattgcaaggcagaaggtccgggatgccgagaaacagtacgaaaaggaccccgatgagcttaacaaacgcgcgctgacagaccgagagggggttgctgccagcatacaggcaaagatcgatgaattgaaacgtcaattagccgacagaattgctactggaaagaatctgggtaaggagcaggatcctacgggcgtggaaccaggggaccatctaaaagagaggtccatgctctcttatggaaacgtactggatcttaatcacctggacatcgatgagccgaccggccagacagcagactggttgtcaattgtggtctacctcaccagtttcgtggttcccatcctgctgaaggccctctatatgttaactacacggggtcgccagaccactaaagataacaaggggacaagaataaggtttaaagacgacagctccttcgaagatgtgaatggaatccggaagcctaagcatctgtacgtctctcttccaaacgctcaatcgtcaatgaaagccgaggaaattacccccggccgctatcgaacggcgatctgcggcttgtaccctgcacagattaaggccagacagatgatcagcccagtgatgagtgtaatagggtttctggctctagccaaagactgggcagataggattgagcagtggctctccgaaccctgtaagctgcttcctgacactgctgccgtttctctgcacggaggtccagcgaccaatcgggattatttgcgtcaacgccaggtggccctcggcaacatggagacaaaagagagcaaggcaatcagacagcatgctgaaactgccgggtgctccatgattgaggacatcgaatcaccgagtagcatctgggtcttcgctggagcccccgataggtgtcctccaacctgcctgtttattgcaggcatagccgagttaggtgctttcttttctatcctgcaagacatgcggaatacaattatggcgtccaaaaccgtggggacgtcagaagagaagctccgaaagaaaagcagtttctaccagtcttaccttcgcagaactcagtccatgggaatccagctggatcaaaggataattgtgttgtttatggtcgcatggggcaaggaggccgttgacaacttccacctaggcgatgacatggaccccgaactgcggacactcgctcagagcctgatcgatgtgaaagtaaaggagatctcgaatcaggaacctcttaaactgtga

SEQ ID NO: 5673 - RNA, 1290 nt, synthetic construct
  misc_feature 1..1290: note = derived and/or modified CDS sequence (opt3) from HTNV(LongquanAa-08-157)__JQ912698.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtggtctacctcaccagtttcgtggttcccatcctgctgaaggccctctatatgttaactacacggggtcgccagaccactaaagacaataaggggacaagaataaggtttaaagatgacagctccttcgaagacgtgaacggaatccggaagcctaagcatctgtacgtctctcttccaaatgctcaatcgtcaatgaaagccgaggaaattacccccggccgctatcgaacggcgatctgcggcttgtaccctgcacagattaaggccagacagatgatcagcccagtgatgagtgtaatagggtttctggctctagccaaagattgggcagacaggattgagcagtggctctccgaaccctgtaagctgcttcctgatactgctgccgtttctctgcacggaggtccagcgaccaaccgggactatttgcgtcaacgccaggtggccctcggcaatatggagacaaaagagagcaaggcaatcagacagcatgctgaaactgccgggtgctccatgattgaggatatcgaatcaccgagtagcatctgggtcttcgctggagcccccgacaggtgtcctccaacctgcctgtttattgcaggcatagccgagttaggtgctttcttttctatcctgcaagatatgcggaacacaattatggcgtccaaaaccgtggggacgtcagaagagaagctccgaaagaaaagcagtttctaccagtcttaccttcgcagaactcagtccatgggaatccagctggaccaaaggataattgtgttgtttatggtcgcatggggcaaggaggccgttgataatttccacctaggcgacgatatggaccccgaactgcggacactcgctcagagcctgatcgacgtgaaagtaaaggagatctcgaaccaggaacctcttaaactgtga

SEQ ID NO: 5674 - RNA, 1290 nt, synthetic construct
  misc_feature 1..1290: note = derived and/or modified CDS sequence (opt3) from HTNV(LongquanAa-08-314)__JQ912709.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatgcaggcaaagatagacgaattgaaacgtcaattagccgatagaatcgctactggaaagaacctgggtaaggagcaggaccctacgggcgtggaaccaggggatcatctaaaagagaggtccatgctctcttatggaaatgtactggaccttaaccacctggatattgacgagccgaccggccagacagcagattggttgtcaatcgtggtctacctcaccagtttcgtggttcccattctgctgaaggccctctatatgttaactacacggggtcgccagaccactaaagacaataaggggacaagaatcaggtttaaagatgacagctccttcgaagacgtgaacggaatacggaagcctaagcatctgtacgtctctcttccaaatgctcaatcgtcaatgaaagccgaggaaatcacccccggccgctatcgaacggcgatttgcggcttgtaccctgcacagatcaaggccagacagatgattagcccagtgatgagtgtaatcgggtttctggctctagccaaagattgggcagacaggatagagcagtggctctccgaaccctgtaagctgcttcctgatactgctgccgtttctctgcacggaggtccagcgaccaaccgggactatttgcgtcaacgccaggtggccctcggcaatatggagacaaaagagagcaaggcaattagacagcatgctgaaactgccgggtgctccatgatcgaggatattgaatcaccgagtagcatctgggtcttcgctggagcccccgacaggtgtcctccaacctgcctgtttatcgcaggcattgccgagttaggtgctttcttttctatactgcaagatatgcggaacacaatcatggcgtccaaaaccgtggggacgtcagaagagaagctccgaaagaaaagcagtttctaccagtcttaccttcgcagaactcagtccatgggcattcagctggaccaaaggatcatagtgttgtttatggtcgcatggggaaaggaggccgttgataatttccacctaggcgacgatatggaccccgaactgcggacactcgctcagagcctgattgacgtgaaagtaaaggagatctcgaaccaggaacctcttaaactgtga

SEQ ID NO: 5675 - RNA, 1290 nt, synthetic construct
  misc_feature 1..1290: note = derived and/or modified CDS sequence (opt3) from HTNV(LongquanAa-08-573)__JQ912714.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtggtctacctcaccagtttcgtggttcccatcctgctgaaggccctctatatgttaactacacggggtcgccagaccactaaagacaataaggggacaagaataaggtttaaagatgacagctccttcgaagacgtgaacggaatccggaagcctaagcatctgtacgtctctcttccaaatgctcaatcgtcaatgaaagccgaggaaattacccccggccgctatcgaacggcgatctgcggcttgtaccctgcacagattaaggccagacagatgatcagcccagtgatgagtgtaatagggtttctggctctagccaaagattgggcagacaggattgagcagtggctctccgaaccctgtaagctgcttcctgatactgctgccgtttctctgcacggaggtccagcgaccaaccgggactatttgcgtcaacgccaggtggccctcggcaatatggagacaaaagagagcaaggcaatcagacagcatgctgccactgctgggtgctccatgattgaagatatcgagtcaccgagtagcatctgggtcttcgccggagcacccgacaggtgtcctccaacctgcctgtttattgccggcatagctgaattaggtgcgttcttttctatcctgcaagatatgcggaacacaattatggcatccaaaaccgtggggacgtcagaggaaaagctccgaaagaaaagcagtttctaccagtcttaccttcgcagaactcagtccatgggaatccagctggaccaaaggataattgtgttgtttatggtcgcctggggcaaggaggctgttgataatttccacctaggcgacgatatggaccccgagctgcggacactcgcccagagcctgatcgacgtgaaagtaaaggaaatctcgaaccaggagcctcttaaactgtga

SEQ ID NO: 5676 - RNA, 1290 nt, synthetic construct
  misc_feature 1..1290: note = derived and/or modified CDS sequence (opt3) from HTNV(LongquanAa-09-113)__JQ912716.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtggtctacctcaccagtttcgtggttcccatcctgctgaaggccctctatatgttaactacacggggtcgccagaccactaaagacaataaggggacaagaataaggtttaaagatgacagctccttcgaagacgtgaacggaacccggaagcctaagcatctgtacgtctctcttccaaatgctcaatcgtcaatgaaagccgaggaaatcacgcccggccgctatcgaactgcgatttgcggcttgtaccctgcacagatcaaggccagacagatgattagcccagtgatgagtgtaatcgggtttctggctctagccaaagattgggcagacaggatagagcagtggctctccgaaccctgtaagctgcttcctgataccgctgccgtttctctgcacggaggtccagcgacaaaccgggactatttgcgtcaacgccaggtggccctcggcaatatggagactaaagagagcaaggcaattagacagcatgctgaaaccgccgggtgctccatgatcgaggatattgaatcaccgagtagcatctgggtcttcgctggagcccccgacaggtgtcctccaacatgcctgtttatcgcaggcattgccgagttaggtgctttcttttctatactgcaagatatgcggaacaccatcatggcgtccaaaacggtggggacttcagaagagaagctccgaaagaaaagcagtttctaccagtcttaccttcgcagaacacagtccatgggcattcagctggaccaaaggatcatagtgttgtttatggtcgcatggggaaaggaggccgttgataatttccacctaggcgacgatatggaccccgaactgcggaccctcgctcagagcctgattgacgtgaaagtaaaggagatctcgaaccaggaacctcttaaactgtga

SEQ ID NO: 5677 - RNA, 1290 nt, synthetic construct
  misc_feature 1..1290: note = derived and/or modified CDS sequence (opt3) from HTNV(LongquanAa-09-191)__JQ912719.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtggtctacctcaccagtttcgtggttcccatcctgctgaaggccctctatatgttaactacacggggtcgccagaccataaaagacaataaggggactagaatcaggtttaaagatgacagctccttcgaagacgtgaacggcattcggaagcctaagcatctgtacgtctctcttccaaatgctcaatcgtcaatgaaagccgaggaaatcacacccggacgctatcgaaccgcgatttgcggcttgtaccctgcacagatcaaggccagacagatgataagcccagtgatgagtgtaattgggtttctggctctagccaaagattgggcagacaggatcgagcagtggctctccgaaccctgtaagctgcttcctgatacggctgccgtttctctgcacggaggtccagcgactaaccgggactatttgcgtcaacgccaggtggccctcggcaatatggagaccaaagagagcaaggcaattagacagcatgctgaaacagccgggtgctccatgatcgaggatatcgaatcaccgagtagcatttgggtcttcgctggagcccccgacaggtgtcctccaacttgcctgtttatagcaggcatcgccgagttaggtgctttcttttctattctgcaagatatgcggaacaccatcatggcgtccaaaacagtggggacctcagaagagaagctccgaaagaaaagcagtttctaccagtcttaccttcgcagaacgcagtccatgggaatacagctggaccaaaggattatcgtgttgtttatggtcgcatggggcaaggaggccgttgataatttccacctaggcgacgatatggaccccgaactgcggactctcgctcagagcctgatcgacgtgaaagtaaaggagatttcgaaccaggaacctcttaaactgtga

SEQ ID NO: 5678 - RNA, 1290 nt, synthetic construct
  misc_feature 1..1290: note = derived and/or modified CDS sequence (opt3) from HTNV(LongquanAa-09-192)__JQ912720.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatgcagggaaagatagacgaattgaaacgtcaattagcagatagaatcgccactggtaagaacctgggcaaggagcaggaccctacgggggtggaaccaggagatcatctaaaagagaggtccatgctctcttatggcaatgtactggaccttaaccacctggatattgacgagccgaccggtcagacagctgattggttgtcaatcgtggtctacctcaccagtttcgtggttcccattctgctgaaggcactctatatgttaactacacgggggcgccagaccactaaagacaataagggaacaagaatcaggtttaaagatgacagctccttcgaagacgtgaacggcatacggaagcctaagcatctgtacgtctctcttccaaatgcccaatcgtcaatgaaagctgaggaaatcacccccggccgctatcgaacggccatttgcgggttgtaccctgcgcagatcaaggcaagacagatgattagcccagtgatgagtgtaatcggatttctggccctagctaaagattgggccgacaggatagagcagtggctctccgaaccctgtaagctgcttcctgatactgcagctgtttctctgcacggtggcccagccaccaaccgggactatttgcgtcaacgccaggtggcgctcgggaatatggagacaaaagagagcaaggccattagacagcatgcagaaactgctggatgctccatgatcgaggatattgaatcaccgagtagcatctgggtcttcgccggcgctcccgacaggtgtcctccaacctgcctgtttatcgccggtattgcagagttaggggccttcttttctatactgcaagatatgcggaacacaatcatggcttccaaaaccgtgggaacgtcagaagagaagctccgaaagaaaagcagtttctaccagtcttaccttcgcagaactcagtccatgggcattcagctggaccaaaggatcatagtgttgtttatggtcgcgtggggcaaggaggcagttgataatttccacctaggggacgatatggaccccgaactgcggacactcgcccagagcctgattgacgtgaaagtaaaggagatctcgaaccaggaacctcttaaactgtga

SEQ ID NO: 5679 - RNA, 1290 nt, synthetic construct
  misc_feature 1..1290: note = derived and/or modified CDS sequence (opt3) from HTNV(LongquanAa-10-46)__JQ912754.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtggtctacctcactagcttcgtggttcccatcctgctgaaggccctctatatgttaaccacacggggtcgccagaccactaaagacaataaggggacaagaataaggtttaaagatgacagctccttcgaagacgtgaacggaatccggaagcctgagcatctgtacgtctctcttccaaatgctcaatcgtcaatgaaggccgaagagattacccccggccgctatcgaacggcgatctgcggcttgtaccctgcacagattaaagccagacagatgatcagcccagtgatgagtgtaatagggtttctggctctagccaaggattgggcagacaggattgaacagtggctctccgagccctgtaaactgcttcctgatactgctgccgtttctctgcacggaggtccagcgaccaaccgggactatttgcgtcaacgccaggtggccctcggcaatatggagacaaaggaaagcaaagcaatcagacagcatgctgagactgccgggtgctccatgattgaagatatcgagtcaccgagtagcatctgggtcttcgctggagcccccgacaggtgtcctccaacctgcctgtttattgcaggcatagccgaattaggtgctttcttttctatcctgcaagatatgcggaacacaattatggcgtccaagaccgtggggacgtcagaggagaaactccgaaagaagagtagtttctaccagtcttaccttcgcagaactcagtccatgggaatccagctggaccaaaggataattgtgttgtttatggtcgcatggggcaaagaagccgttgataatttccacctaggcgacgatatggaccccgagctgcggacactcgctcagagcctgatcgacgtgaaggtaaaagaaatctcgaaccaggagcctcttaagctgtga

SEQ ID NO: 5680 - RNA, 1290 nt, synthetic construct
  misc_feature 1..1290: note = derived and/or modified CDS sequence (opt3) from HTNV(LongquanAa-11-745)__KC344237.1__N
  source 1..1290: mol_type = other RNA
atggccaccatggaggaactgcagaaggagatcaacgctcacgaaggccaactcgtgattgcaagacagaaagtcagggacgccgagaagcagtacgaaaaagatcccgacgagcttaataagcgggcgctgacagatcgcgagggggttgctgccagcatacaggcaaaaatcgacgaattgaagcgacaattagccgatcgtattgctactggaaagaacctgggtaaagagcaggaccctacgggcgtggaaccaggggatcatctaaaggagagatccatgctctcttatggaaatgtactggaccttaaccacctggatatcgacgagccgaccggccagacagcagattggttgtcaattgtggtctacctcaccagtttcgtggttcccatcctgctgaaagccctctatatgttaactacaaggggtcggcagaccactaaggacaataaagggacacgcataagatttaaggatgacagctccttcgaagacgtgaacggaatcaggaagcctaaacatctgtacgtctctcttccaaatgctcaatcgtcaatgaaggccgaggaaattacccccggccggtatcgcacggcgatctgcggcttgtaccctgcacagattaaagcccgacagatgatcagcccagtgatgagtgtaatagggtttctggctctagccaaggattgggcagacagaattgagcagtggctctccgaaccctgtaaactgcttcctgatactgctgccgtttctctgcacggaggtccagcgaccaacagggactatttgcggcaacgtcaggtggccctcggcaatatggagacaaaggagagcaaagcaatccgccagcatgctgaaactgccgggtgctccatgattgaggatatcgaatcaccgagtagcatctgggtcttcgctggagcccccgacagatgtcctccaacctgcctgtttattgcaggcatagccgagttaggtgctttcttttctatcctgcaagatatgaggaacacaattatggcgtccaagaccgtggggacgtcagaagagaagctccggaaaaagagcagtttctaccagtcttaccttcgacgcactcagtccatgggaatccagctggaccaaagaataattgtgttgtttatggtcgcatggggcaaagaggccgttgataatttccacctaggcgacgatatggaccccgaactgaggacactcgctcagagcctgatcgacgtgaaggtaaaagagatctcgaaccaggaacctcttaagctgtga

SEQ ID NO: 5681 - RNA, 1290 nt, synthetic construct
  misc_feature 1..1290: note = derived and/or modified CDS sequence (opt3) from HTNV(ROKA14-11)__KU207207.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccgtatgcggcttgtaccctgcgcagatcaaggcaagacagatgattagcccagttatgagtgtgatcgggtttctggccctagctaaagattggtccgacaggatagagcagtggctctctgaaccctgtaagctgcttcctgatactgccgcagtcagcctgttgggaggtccagctaccaaccgggactatctccgtcaacgccaggtggccctgggcaatatggagacaaaagagtccaaggcgattagacagcacgccgaagcagctgggtgctcaatgatcgaggatattgaaagtccgagctctatctgggtgttcgccggagctcccgacaggtgtcctccaacttgcttatttgtcgccggcatcgcagagctgggtgccttcttttccattctccaagatatgcggaacaccataatggcttcaaaaacagttgggaccagcgaagagaagatgcgaaagaaaagttctttctaccagtcctaccttcgcagaacgcagagcatgggaatccagctggaccaaaggattatcgtgttgtttatggtagcgtggggcaaggaggcagtggataatttccatctaggcgacgatatggaccccgaactgcggactctcgcccagtcgctgatagacgtcaaagtgaaggagatttctaaccaggaacctcttaaactgtga

SEQ ID NO: 5682 - RNA, 1290 nt, synthetic construct
  misc_feature 1..1290: note = derived and/or modified CDS sequence (opt3) from HTNV(US8A14-2)__KU207208.1__N
  source 1..1290: mol_type = other RNA
atggccaccatggaggaactgcagagagagatcaacgctcacgaaggccaactcgtgattgcaaggcagaaggtccgggacgccgagaaacaggatgggaaggaccccgatgaacttaataaacgcgcgctgacagaccgagagggagttgctgtgagcatacaggccaagatcgatgagttgaaacgtcaattagcagacagaattgccactggtaagaacctgggcaaggaacaggatcctacgggggtagagccaggagaccatctaaaagaaaggtccatgctctcttacggcaatgtgctggatcttaaccacctggacatcgatgagccgaccggtcagacagctgactggttgtcaattgtcgtgtatctcaccagtttcgttgtgcccatcctgctgaaggcactctacatgttaactacacgggggcgccagaccactaaagataataagggaacaagaataaggtttaaagacgacagctccttcgaggatgtcaacggcatccggaagcctaagcatctgtatgtgtctcttccaaatgcccaatcgtcaatgaaagctgaagagattacccccggccgctaccgaacggccgtatgcgggttgtatcctgcgcagatcaaggcaagacagatgattagcccagttatgagtgtgatcggatttctggccctagctaaagactggtccgataggatagaacagtggctctctgagccctgtaagctgcttcctgacactgccgcagtcagcctgttgggtggcccagctaccaaccgggattacctccgtcaacgccaggtggccctggggaatatggaaacaaaagagtccaaggcgattagacagcacgccgaggcagctggatgctcaatgatcgaagacattgagagtccgagctctatctgggtgttcgccggcgctcccgataggtgtcctccaacttgcttatttatcgccggtattgcagaactgggggccttcttttccatactccaagacatgcggaacaccatcatggcttcaaaaacagtcggaaccagcgaggaaaaacttcgaaagaagagttctttctatcagtcctacctgcgcagaacgcagagcatgggcattcagttggatcaaaggatcatagttctatttatggtggcgtggggcaaggaggcagtagacaatttccatctgggggatgacatggaccccgagctccggactctggcccagtcgcttattgatgtgaaagtcaaggaaatctctaaccaggagcctctgaaattgtga

SEQ ID NO: 5683 - RNA, 1290 nt, synthetic construct
  misc_feature 1..1290: note = derived and/or modified CDS sequence (opt3) from HTNV(US8A15-1)__KU207209.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccgtatgcggcttgtaccctgcgcagatcaaggcaagacagatgattagcccagttatgagtgtgatcgggtttctggccctagctaaagattggtccgacaggatagagcagtggctctctgaaccctgtaagctgcttcctgatactgccgcagtcagcctgttgggaggtccagctaccaaccgggactatctccgtcaacgccaggtggccctgggcaatatggagacaaaagagtccaaggcgattagacagcacgccgaagcagctgggtgctcaatgatcgaggatattgaaagtccgagctctatctgggtgttcgccggagctcccgacaggtgtcctccaacttgcttatttatcgccggcattgcagagctgggtgccttcttttccatactccaagatatgcggaacaccatcatggcttcaaaaattgtcgggacaagcgaagagaaacttcgaaagaagagttctttctaccagtcctacctgcgcagaacccagagcatgggaatccagttggaccaaaggataattgttctatttatggtggcgtggggcaaggaggcagtagataatttccatctgggcgacgatatggaccccgaactccggacgctggcccagtcgcttatcgacgtgaaagtcaaggagatctctaaccaggaacctctgaaattgtga

SEQ ID NO: 5684 - RNA, 1290 nt, synthetic construct
  misc_feature 1..1290: note = derived and/or modified CDS sequence (opt3) from HTNV(YaluRiver13)__HQ611981.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtgggcagaccactaaagacaataagggaacacgcataagatttaaagatgacagctccttcgaagacgtcaacggcatcaggaagcctaagcatctgtacgtgtctcttccaaatgcccaatcgtcaatgaaagctgaggaaattacccccggccggtatcgcacggccatctgcgggttgtaccctgcgcagattaaggcacgacagatgatcagcccagtaatgagtgttataggatttctggccctagctaaagattggtccgacagaattgagcagtggctctctgaaccctgtaagctgcttcctgatactgccgcagtgagcctgttgggtggcccagctaccaacagggactatctccggcaacgtcaggtcgccctggggaatatggagacaaaagagtccaaggcgatccgccagcacgccgaagcagctggatgctcaatgattgaggatatcgaaagtccgagctctatctgggtgttcgccggcgctcccgacagatgtcctccaacttgcttatttattgcctccataggtgagctgggggcattcttttcaatcctccaagatatgaggaacaccattatggccagcaaaacagtgggaaccagtgaagagaaacttcggaagaagtcttccttctaccagagctacctgcgacgcacgcagtcgatgggcatccagttggaccaaagaataattgtcctatttatggtttcttggggcaaggaggctgtggataatttccatctgggggacgatatggaccccgaactcaggactctggcgcagtcccttatcgacgtaaaagtgaaggagatccctaaccaggaaccactgaaattgtga

SEQ ID NO: 5685 - RNA, 1290 nt, synthetic construct
  misc_feature 1..1290: note = derived and/or modified CDS sequence (opt3) from HTNV(84FLi)__AY017064.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaactacctggatatcgacgagccgacaggccagactgctgattggttgtcaattgtgatctatctcaccagtttcgtcgtgcccatactgctgaaggcactctacatgttaacaacccggggtcgccagactacaaaagacaataaggggaccagaatcaggtttaaagatgacagctccttcgaagacgttaacggcattcggaagcctaagcacctgtatgtgtctcttccaaatgcccaatcgtcaatgaaagctgaggaaatcacgcccggacgctaccgaactgccatttgcggcttgtatcctgcgcagatcaaggcaagacagatgataagcccagtcatgagtgtgattgggtttctggccctagctaaagattggtccgacaggatcgagcagtggctctctgaaccctgtaagctgcttcctgataccgccgcagtaagcctgcatggaggtccagctacaaaccgggactacttgcgtcaacgccaggttgccctcggcaatatggagactaaagagtccaaggcgattagacagcacgccgaatcagcagggtgcagtatgatcgaggatatcgaaagcccgtcttccatttgggtgttcgctggagcccccgacaggtgtcctccaacctgcctgtttatagctggcatcgccgagttaggtgcattcttttcaattctgcaagatatgcggaacacaatcatggccagcaaaaccgtcgggacgagtgaagagaagctccgaaagaaatcttccttctaccagagctatcttcgcagaactcagtcgatgggaatacagctggaccaaaggattatcgtgttgtttatggtggcttggggcaaggaggcggtcgataatttccatctaggcgacgatatggaccccgaactgcggacactcgcacagtctctgatcgacgttaaagtgaaggagatttccaaccaggaacctcttaaactgtga

SEQ ID NO: 5686 - RNA, 1290 nt, synthetic construct
  misc_feature 1..1290: note = derived and/or modified CDS sequence (opt3) from HTNV(Bao14)__AB127998.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggtgagcatacaggctaagatcgacgaattgaaacgtcaattagccgatagaattgcaacgggaaagaacctgggtaaggagcaggaccctaccggcgtagaaccaggggatcatctaaaagagaggtccatgctctcttatggaaatgtgctggaccttaaccacctggatatcgacgagccgacaggccagactgccgattggttgtcaattgtcgtgtacctcaccagtttcgttgtgcccatcctgctgaaggctctctatatgttaacaacccggggtcgccagactacaaaagacaataaggggaccagaataaggtttaaagatgacagctccttcgaagacgtcaacggaatccggaagcctaagcatctgtacgtgtctcttccaaatgcacaatcgtcaatgaaagccgaggaaattacgcccggccgctatcgaactgctatctgcggcttgtaccctgcccagattaaggcgagacagatgatcagcccagtaatgagtgttatagggtttctggcactagccaaagattggtccgacaggattgagcagtggctctctgaaccctgtaagctgcttcctgataccgctgccgtgagcctgttgggaggtccagcaacaaaccgggactatctccgtcaacgccaggtcgctctgggcaatatggagactaaagagtccaaggccatcagacagcacgcggaagccgcagggtgctcaatgattgaggatatcgaaagtccgagctctatctgggtgttcgctggagcccccgacaggtgtcctccaacctgcttatttattgctggcatagccgagctgggtgcattcttttccatcctccaagatatgcggaacacaattatggcctcaaaaaccgtggggacgagcgaagagaaacttcgaaagaagagttctttctaccagtcctacctgcgcagaactcagagcatgggaatccagttggaccaaaggataattgtcctatttatggttgcttggggcaaggaggcggtggataatttccatctgggcgacgatatggaccccgaactccggacactggcacagtcgcttatcgacgtaaaagtgaaggagatctctaaccaggaacctctgaaattgtga

SEQ ID NO: 5687 - RNA, 1290 nt, synthetic construct
  misc_feature 1..1290: note = derived and/or modified CDS sequence (opt3) from HTNV(Chen4)__AB027101.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctgtacgtgtctcttccaaatgcccaatcgtcaatgaaagctgaggaaatcacgcccggacgctatcgaactgccatttgcggcttgtaccctgcgcagatcaaggcaagacagatgataagcccagtcatgagtgtgattgggtttctggccctagctaaagattggtccgacaggatcgagcagtggctctctgccccctgtaagctgcttcctgataccgcagctgtaagcctgcacggaggtccagccacaaaccgggacaatttgcgtcaacgccaggttgcgctcggcaacatggaaactaaagagtccaaggccattagacagcatgcagagtcagctgggtgcagtatgatcgaagatatcgagagcccgtcttccatttgggtgttcgccggagctcccgacaggtgtcctccaacctgcctgtttatagccggcatcgcagaattaggtgccttcttttcaattctgcaagatatgcggaatacaatcatggctagcaaaaccgtcgggacgagtgaggaaaagctccgaaagaaatcttccttctatcagagctaccttcgcagaactcagtcgatgggaatacagctggaccaaaggattatcgtgttgtttatggtggcgtggggcaaggaggcagtcgataacttccggctaggcgacgatatggaccccgagctgcgcacactcgcccagtctctgatcgacgttaaagtgaaggaaatttccaatcaggagcctcttaaactgtga

SEQ ID NO: 5688 - RNA, 1290 nt, synthetic construct
  misc_feature 1..1290: note = derived and/or modified CDS sequence (opt3) from HTNV(Hu)__AB027111.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtgatctacctcaccagtttcgtcgtgcccatactgctgaaggccctctatatgttaactacacggggtcgccagaccactaaagacaataaggggacaagaatcaggtttaaagatgacagctccttcgaagacgttaacggcattcggaagcctaagcatctgtacgtgtctcttccaaatgctcaatcgtcaatgaaagccgaggaaatcacccccggacgctatcgaacggcgatttgcggcttgtaccctgcacagatcaaggccagacagatgataagcccagtcatgagtgtgattgggtttctggctctagccaaagattggtccgacaggatcgagcagtggctctctgaaccctgtaagctgcttcctgatactgcagctgtaagcctgcacggaggtccagccaccaaccgggactatttgcgtcaacgccaggttgcgctcggcaatatggagacaaaagagtccaaggccattagacagcatgcagaagctgccgggtgctcaatgatcgaggatatcgaaagtccgagctctatttgggtgttcgctggagcccccgacaggtcccctccaacttgtatgtttatagcaggcatcgatgagctgggtgccttcttttcaattttacaagacatgcggaacaccatcatggctagcaaaacagtcgggaccagtgaagagaagctgcgaaagaaatcttccttctaccagagctacctccgcagaacgcagtcgatgggaatacagcttgatcaaaggattatcgtgctgtttatggtggcgtggggcaaggaggcagtcgacaatttccacttgggcgatgacatggaccccgaactacggactctggcccagtctctcatcgatattaaagttaaggagatctccaaccaggaacctctgaaactttga

SEQ ID NO: 5689 - RNA, 1290 nt, synthetic construct
  misc_feature 1..1290: note = derived and/or modified CDS sequence (opt3) from HTNV(HubeiHu02)__JQ665905.1__N
  source 1..1290: mol_type = other RNA
atggccaccatggaggaactgcagaaggagatcaacgctcacgaaggccaactcgtgattgcaagacagaaagtcagggacgccgagaagcagtacgaaaaagatcccgacgagcttaataagcggacactgactgatcgcgagggggttgcggctagcatacaggccaaaatcgacgaattgaagcgacaattagcagatcgtattgccacgggaaagaacctgggtaaagagcaggaccctaccggcgtggaaccaggggatcatctaaaggagagatccatgctctcttatggaaatgtactggaccttaaccacctggatatcgacgagccgacaggccagactgctgattggttgtcaattgtgatctacctcaccagtttcgtcgtgcccatactgctgaaagcactctatatgttaacaaccaggggtcggcagactacaaaggacaataaagggacccgcatcagatttaaggatgacagctccttcgaagacgttaacggaattaggaagcctaaacatctgtacgtgtctcttccaaatgcccaatcgtcaatgaaggctgaggatatcacgcccggccggtatcgcactgccatttgcggcttgtaccctgcgcagatcaaagcacgacagatgataagcccagtcatgagtgtgattgggtttctggccctagctaaggactggtccgatagaatcgaacagtggctctctgagccctgtaaactgcttcctgacaccgccgcagtaagcctgcacggaggtccagctacaaacagggattatttgcggcaacgtcaggttgccctcggcaatatggaaactaaggagtccaaagcgattcgccagcatgccgagtcagcagggtgcagtatgatcgaagacatcgagagcccgtcttccatttgggtgttcgctggagcccccgatagatgtcctccaacctgcctgtttatagctggcatcgccgaattaggtgcattcttttcaattctgcaagacatgaggaacacaatcatggccagcaagaccgtcgggacgagtgaggaaaagctccggaaaaagtcttccttctaccagagctaccttcgacgcactcagtcgatgggaatacagctggatcaaagaattatcgtgttgtttatggtggcttggggcaaagaggcggtcgacaatttccacctaggcgatgacatggaccccgagctgaggacactcgcacagtctctgatcgatgttaaggtgaaagaaatttccaaccaggagcctcttaagctgtga

SEQ ID NO: 5690 - RNA, 1290 nt, synthetic construct
  misc_feature 1..1290: note = derived and/or modified CDS sequence (opt3) from HTNV(HV004)__JQ083395.1__N
  source 1..1290: mol_type = other RNA
atggccaccatggaggaactgcagaaggagatcaacgctcacgaaggccaactcgtgattgcaagacagaaagtcagggacgccgagaagcagtacgaaaaagatcccgacgagcttaataagcgggcgctgacagatcgcgagggggttgctgccagcatacaggcaaaaatcgacgaattgaagcgacaattagccgatcgtattgctactggaaagaacctgggtaaagagcaggaccctacgggcgtggaaccaggggatcatctaaaggagagatccatgctctcttatggaaatgtactggaccttaaccacctggatatcgacgagccgaccggccagacagcagattggttgtcaattgtgatctacctcaccagtttcgtcgtgcccatactgctgaaagccctctatatgttaactacaaggggtcggcagaccactaaggacaataaagggacacgcatcagatttaaggatgacagctccttcgaagacgttaacggaattaggaagcctaaacatctgtacgtgtctcttccaaatgctcaatcgtcaatgaaggccgaggaaatcacccccggccggtatcgcacggcgatttgcggcttgtaccctgcacagatcaaagcccgacagatgataagcccagtcatgagtgtgattgggtttctggctctagccaaggattggtccgacagaatcgagcagtggctctctgaaccctgtaaactgcttcctgatactgcagctgtaagcctgcacggaggtccagccaccaacagggactatttgcggcaacgtcaggttgcgctcggcaatatggagacaaaggagtccaaagccattcgccagcatgcagaatcagctgggtgcagtatgatcgaggatatcgaaagcccgtcttccatttgggtgttcgccggagctcccgacagatgtcctccaacttgcctgtttatagccggcatcgcagagttaggtgccttcttttcaattctgcaagatatgaggaacaccatcatggctagcaagacagtcgggaccagtgaagagaagctccggaaaaagtcttccttctaccagagctaccttcgacgcacgcagtcgatgggaatacagctggaccaaagaattatcgtgttgtttatggtggcgtggggcaaagaggcagtcgataatttccacctaggcgacgatatggaccccgaactgaggactctcgcccagtctctgatcgacgttaaggtgaaagagatttccaaccaggaacctcttaagctgtga

SEQ ID NO: 5691 - RNA, 1290 nt, synthetic construct
  misc_feature 1..1290: note = derived and/or modified CDS sequence (opt3) from HTNV(Maaji-1)__AF321094.1__N
  source 1..1290: mol_type = other RNA
atggccaccatggaggaactgcagaaggagatcaacgctcacgaaggccaactcgtgattgcaagacagaaagtcagggacgccgagcggcagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctgtacgtgtctcttccaaatgcccaatcgtcaatgaaagctgaggaaatcacgcccggacgctatcgaactgccgtctgcggcttgtaccctgcgcagattaaggcaagacagatgatcagcccagtgatgagtgtaatagggtttatggccctggctaaagattggtccgagaggattgaacagtggctatctgagccctgtaagctcctgcctgacaccagcgccgtttcccttctgggaggtccagcaacaaacaaagattatttgcggcaacgtcaggtggctctcggcaatatggagactaaggaatcaaaagccatccgccagcaagcggaggccagtgggtgcagcatgattgaagacatcgagtctccgtcctcaatctgggtcttcgcaggagctcccgatagatgtcctccaacctgcctgtttattgccggcatggctgaattaggtgccttctttagcatactgcaggacatgaggaacacaatcatggcaagtaagaccgtggggacgtctgaggagaagctccggaaaaagtccagcttctaccagtcgtaccttcgacgcactcagtctatgggcattcaactggatcagagaatcatagtgttgtttatggtcgcctggggaaaagaagctgttgacaatttccacctaggcgatgacatggatcccgagctgaggacactcgcgcagtccctgattgacgtgaaggtaaaagaaatctcaaaccaggagcctcttaagctgtga

SEQ ID NO: 5692 - RNA, 1290 nt, synthetic construct
  misc_feature 1..1290: note = derived and/or modified CDS sequence (opt3) from HTNV(Maaji-2)__AF321095.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggtgagcatacaggctaagatcgacgaattgaaacgtcaattagccgatagaattgcaacgggaaagaacttcggtaaggagcaggaccctaccggcgtagaaccaggggatcatctgaaagagaggtccatgctatcttatggaaatgtgctcgacctgaaccaccttgatatcgacgagccgacaggccagactgccgattggctgtcaattgtcgtgtacttgaccagttttgttgtgcccatcctcctgaaggctctgtatatgctcacaacccggggtcgccagactacaaaagacaataaggggaccagaataaggttcaaagatgacagctcctttgaagacgtcaacggaatccggaagcctaagcatttatacgtgtctctgccaaatgcacaatcgtcaatgaaagccgaggaaattacgcccggccgctatcgaactgctgtatgcggcctttaccctgcccagatcaaggcgagacagatgattagcccagttatgagtgtgatcgggttcttggcactggccaaagattggtccgacaggatagagcagtggctatctgaaccctgtaagctcctgcctgataccgctgccgtcagccttctgggaggtccagcaacaaaccgggactatttgcgtcaacgccaggtggctctcggcaatatggagactaaagagtccaaggccattagacagcacgcggaagccgcagggtgctcaatgatcgaggatattgaaagtccgagctctatctgggtgtttgctggagcccccgacaggtgtcctccaacctgcctgttcatcgctggcattgccgagttaggtgcatttttctccatactgcaagatatgcggaacacaatcatggcctcaaaaaccgtcgggacgagcgaagagaagctccgaaagaaaagttctttttaccagtcctaccttcgcagaactcagctgatgggcattcagttggaccaaaggatcatagttctattcatggtggcttggggaaaggaggcggtagataattttcatctgggcgacgatatggaccccgaactccggacactggcacagagccttattgacgtgaaagtcaaggagatctcgaaccaggaacctctgaaattgtga

SEQ ID NO: 5693 - RNA, 1290 nt, synthetic construct
  misc_feature 1..1290: note = derived and/or modified CDS sequence (opt3) from HTNV(N8)__DQ658415.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctgtacctttctttgccaaatgcccaatcgtcaatgaaagctgaggaaatcacgcccggacgctatcgaactgccatttgcggcctgtaccctgcgcagatcaaggcaagacagatgataagcccagtgatgagtgtcattgggtttctagccctcgctaaagattggtccgacaggatcgagcagtggctgtctgaaccctgtaaacttctgcctgatgccgcagctgtgagcttgcacggaggtccagccaccaaccgggactatctccgtcaacgccaggtagcgctgggcaatatggagacaaaggagtccaaggccattagacagcatgcagaaactgctgggtgctcaatgatcgatgacatcgagagtccgagctctatttgggttttcgccggagctcccgataggtgtcctccaacctgcttatttatagccggcatcgcagaactgggtgccttcttttccattctccaagacatgcggaacacaatcatggcttcaaaaaccgtggggacgagcgaggaaaaacttcgaaagaagagttctttctaccagtcctacctgcgcagaactcagagcatgggaatacagttggatcaaaggattatcgtcctatttatggtggcgtggggcaaggaggcagtggacaatttccacctgggcgatgacatggaccccgagctccggacactggcccagtcgcttatcgatgtcaaagttaaggaaatttctaaccaggagcctctgaaattgtga

SEQ ID NO: 5694 - RNA, 1290 nt, synthetic construct
  misc_feature 1..1290: note = derived and/or modified CDS sequence (opt3) from HTNV(Q32)__AB027097.1__N
  source 1..1290: mol_type = other RNA
atggccaccatggaggaactgcagagagagatcaacgctcacgaaggccaactcgtgattgcaaggcttaaggtccgggacgccgagaaaccctacgaaaaggatcctgacgagctgaatatgcgcacattgactgatcgagagggggttgcggctagcatacaggccaaaatcgacgaattaaagcgtcagctggcagatagaattgccacgggtaaaaacctaggaaaggagcaggacccaaccggcgtggaaccgggggatcatctcaaggagaggtccatgctgtcttatggaaatgtacttgacctgaaccacttggatatcgacgagcccacaggccaaactgctgattggctctcaattgtgatctacctgaccagtttcgtcgtgcctatactgctcaaagcattatatatgctgacaacccggggtcgccagactacaaaggacaataaagggaccagaatcaggtttaaggatgacagctccttcgaagacgttaacggcattcggaaaccaaagcatctttacgtgtctttgcccaatgcccagtcgtcaatgaaggctgaggaaatcacgcctggacgctatcgaactgccatttgcggcctgtacccagcgcagatcaaagcaagacaaatgataagccccgtcatgagtgtgattgggtttctagccctcgctaaggattggtccgacaggatcgagcagtggctgtctgaaccttgtaaacttctgccagataccgccgcagttagcttgcacggaggtccggctacaaaccgggactatctccgtcagcgccaggtagccctgggcaatatggagactaaggagtccaaagcgattagacaacatgccgaatcagcagggtgcagtatggtggaggatatcgaaagcccctcttccatctgggtcttcgctggagcccctgacaggtgtccacctacctgcttatttattgctggcatagccgagctgggtgcattcttttcaatcctccaggatatgcggaacacaattatggccagcaagaccgtggggacgagtgaagagaaacttcgaaagaagtcttccttctaccagagctacctgcgcagaactcaatcgatgggaatccagttggaccagaggataattgtgctatttatggtcgcttggggcaaagaggcggttgataatttccagcccggcgacgatatggacccagaactgcggacactcgcacaatctctgatcgacgtgaaggtaaaagagatctccaaccaggaaccccttaagctgtga

SEQ ID NO: 5695 - RNA, 1290 nt, synthetic construct
  misc_feature 1..1290: note = derived and/or modified CDS sequence (opt3) from HTNV(SXHu2012B1)__KC844226.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtgatctacctcaccagtttcgtcgtgcccatactgctgaaggccctctatatgttaactacacggggtcgccagaccactaaagacaataaggggacaagaatcaggtttaaagatgacagctccttcgaagacgttaacggcattcggaagcctaagcatctgtacgtgtctcttccaaatgctcaatcgtcaatgaaagccgaggaaatcacccccggacgctatcgaacggcgatttgcggcttgtaccctgcacagatcaaggccagacagatgataagcccagtcatgagtgtgattgggtttctggctctagccaaagattggtccgacaggatcgagcagtggctctctgaaccctgtaagctgcttcctgatactgcagctgtaagcctgcacggaggtccagccaccaaccgggactatttgcgtcaacgccaggttgcgctcggcaatatggagacaaaagagtccaaggccattagacagcatgcagaatcagctgggtgcagtatggtggaggatatcgaaagcccgtcttccatctgggtcttcgccggagctcccgacaggtgtcctccaacttgcctgtttattgccggcatagcagagttaggtgccttcttttcaatcctgcaagatatgcggaacaccattatggctagcaaaacagtggggaccagtgaagagaagctccgaaagaaatcttccttctaccagagctaccttcgcagaacgcagtcgatgggaatccagctggaccaaaggataattgtgttgtttatggtcgcgtggggcaaggaggcagttgataatttccacctaggcgacgatatggaccccgaactgcggactctcgcccagtctctgatcgacgtgaaagtaaaggagatctccaaccaggaacctcttaaactgtga

SEQ ID NO: 5696 - RNA, 1290 nt, synthetic construct
  misc_feature 1..1290: note = derived and/or modified CDS sequence (opt3) from HTNV(TJJ16)__AY839871.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagaggggttggctgccagcatacaggcaaagatcgacgaattaaaacgtcaactggccgatagaattgctactggaaagaacctaggtaaggagagggaccctacgggcgttgaaccaggggatcatctcaaagagcggtccatgctgtcttatggaaatgtgcttgacctgaaccacttggatatcgacgagccgaccggccagacagcagattggctctcaattgtaatctacctgaccagtttcgtggtccccatactgctcaaggccttatatatgctgactacacgcggtagacagaccactaaagacaataaggggacaaggatccggtttaaagatgacagctccttcgaagacgtgaacggcattcgcaagcctaagcatctttacgtttctttgccaaatgctcagtcgtcaatgaaagccgaggaaatcacccccggacgatatagaacggcgatttgcggcctgtaccctgcacaaatcaaggccaggcagatgataagcccagtgatgagtgtcattgggtttctagctctcgccaaagattggtccgaccggatcgagcagtggctgtctgaaccctgtaaacttctgcctgatactgcagctgtgagcttgcacggaggtccagccaccaaccgtgactatctccgccagagacaagtagcgctgggcaatatggagacaaaggagtccaaggccattaggcagcatgcagaatcagctgggtgcagtatggttgaggatatcgaaagcccgtcttccatctgggtgttcgccggagctcccgaccggtgtcctccaacttgcttatacattgccggcatagcagagctgggtgcctttttctcaatcctccaggatatgcgaaacaccattatggctagcaaaacagtcgggaccagtgaagagaaacttcgcaagaagtcttccttttaccaaagctatctgagaaggacgcagtcgatgggaatccagttggaccagcggataattgtgctattcatggtggcgtggggcaaggaggcagtcgataattttcacctgggcgacgatatggaccccgaactccgcactctggcccaatctcttatcgacgttaaagtgaaggagatctccaaccaggaacctctgaaattgtga

SEQ ID NO: 5697 - RNA, 1290 nt, synthetic construct
  misc_feature 1..1290: note = derived and/or modified CDS sequence (opt3) from HTNV(WCL)__KM355414.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattggagcgtcaattagcagatagaattgccactggtaaaaacctgggaaaggaacaggaccctacgggcgtagagccaggggatcatctaaaggagaggtccatgctctcttatggaaatgtgctggaccttaaccacctggatatcgacgaaccgaccggccagacagctgattggttgtcaattgtcgtgtacctcaccagtttcgttgtgcccatcctgctgaaagcactctatatgttaactacacggggtcgccagaccactaaggacaataaagggacaagaataaggtttaaggatgacagctccttcgaggacgtcaacggaatccggaaacctaagcatctgtacgtgtctcttccaaatgcccaatcgtcaatgaaggctgaagagattacccccggccgctatcgaacggccatctgcggcttgtaccctgcgcagattaaagcaagacagatgatcagcccagtaatgagtgttatagggtttctggccctagctaaggattggtccgacaggattgaacagtggctctctgagccctgtaaactgcttcctgatactgccgcagtgagcctgttgggaggtccagctaccaaccgggactatctccgtcaacgccaggtcgccctgggcaatatggagacaaaggaatccaaagcgatcagacagcacgccgaggcagctgggtgctcaatgattgaagatatcgagagtccgagctctatctgggtgttcgccggagctcccgacaggtgtcctccaacttgcttatttattgccggcatagcagaactgggtgccttcttttccatcctccaagatatgcggaacaccattatggcttcaaagacagtggggaccagcgaggagaaacttcgaaagaagagttctttctaccagtcctacctgcgcagaacgcagagcatgggaatccagttggaccaaaggataattgtcctatttatggttgcgtggggcaaagaagcagtggataatttccatctgggcgacgatatggaccccgagctccggactctggcccagtcgcttatcgacgtaaaggtgaaagaaatctctaaccaggagcctctgaagttgtga

SEQ ID NO: 5698 - RNA, 1290 nt, synthetic construct
  misc_feature 1..1290: note = derived and/or modified CDS sequence (opt3) from HTNV(YN509)__GU329991.1__N
  source 1..1290: mol_type = other RNA
atggccaccatggaggaactgcagaaggagatcaacgctcacgaaggccaactcattatagcaaaacagaaggtgaaagacgccgagaagcagtacgaaaaagatcccgacgagcttaataagagagcgctgacagatagggagggggtcgctgccagcatccaggcaaagattgacgaattgaaacggcaattagccgatcgcatcgctactggaaagaacctgggtcaggaccgagatcctacgggcgttgagccaggggaccatctaaaagaacgttccatgctctcttatggaaatattctggatcttaaccacctggacatcgatgagccgaccggccagacagcagactggttgtcaataatcgtgtacctcaccagtttcgtagtgcccattctgctgaaggccctctatatgttaactacaagaggtaggcagaccgctaaagataataaggggactcggatccgctttaaggacgacagctccttcgaggatgtcaacggaattagaaaacctaagcatctgtacgtgtctatgccaaatgcccaatcgtcaatgaaagcggaagagatcacacccggcaggtatcggaccgcagtttgcggcctttaccctgcccagataaaggctcgccagatggtgagcccagtcatgagtgtgattgggtttatggccttggcaaaagactggacggatcgaatcgaaaactggctgggagagccctgtaagctactccctgacacttcctctgtaattctgcttggtggcccagctaccaatagagattatatcaggcagcggcaagttgccctggggaacatggaaacaaaagaggcgaaggccgtgcgtcagcacgcagagagcgctggatgctccatgatcgacaatattgattcaccgagtagcatatgggtcttcgccggcgctcccgaccgctgtcctccaacttgcttgtttgtggccggtctcgcagaactgggggccttcttttctatcttacaggatatgagaaacaccattatggcttccaagacagtgggaacctcagaggagaaaatgaggaagaaaagcagtttctaccaatcttacctgcggcgaacgcagtccatgggcatccagctcgaccagcgcataattgtcctttttatggttgcgtggggcaaggaagcagtggataatttccatctgggggacgacatggatcccgaattgagaaacctagcccaaagcctgatcgaccagaaagtaaaggagatctcgaatcaggagcctctcaagctgtga

SEQ ID NO: 5699 - RNA, 1290 nt, synthetic construct
  misc_feature 1..1290: note = derived and/or modified CDS sequence (opt3) from HTNV(YU62)__AY748309.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagaggggttggctgccagcatacaggcaaagatcgacgaattaaaacgtcaactggccgatagaattgctactggaaagaacctaggtaaggagcaggaccctacgggcgttgaaccaggggatcatctcaaagagaggtccatgctgtcttatggaaatgtgcttgacctgaaccacttggatatcgacgagccgaccggccagacagcagattggctctcaattgtaatctacctgaccagtttcgtggtccccatactgctcaaggccttatatatgctgactacacggggtcgccagaccactaaagacaataaggggacaagaatcaggtttaaagatgacagctccttcgaagacgtgaacggcattcggaagcctaagcatctttacgtttctttgccaaatgctcaatcgtcaatgaaagccgaggaaatcacccccggacgctatcgaacggcgatttgcggcctgtaccctgcacagatcaaggccagacagatgataagcccagtgatgagtgtcattgggtttctagctctcgccaaagattggtccgacaggatcgagcagtggctgtctgaaccctgtaaacttctgcctgatactgcagctgtgagcttgcacggaggtccagccaccaaccgggactatctccgtcaacgccaggtagcgctgggcaatatggagacaaaggagtccaaggccattagacagcatgcagaatcagctgggtgcagtatggttgaggatatcgaaagcccgtcttccatctgggtgttcgccggagctcccgacaggtgtcctccaacttgcttatttattgccggcatagcagagctgggtgccttcttttcaatcctccaagatatgcggaacaccattatggctagcaaaacagtcgggaccagtgaagagaaacttcgaaagaagtcttccttctaccagagctacctgcgcagaacgcagtcgatgggaatccagttggaccaaaggataattgtgctatttatggtggcgtggggcaaggaggcagtcgataatttccacctgggcgacgatatggaccccgaactccggactctggcccagtctcttatcgacgttaaagtgaaggagatctccaaccaggaacctctgaaattgtga

SEQ ID NO: 5700 - RNA, 1290 nt, synthetic construct
  misc_feature 1..1290: note = derived and/or modified CDS sequence (opt3) from HTNV(ZLS6-11)__FJ753396.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtgatctacctcaccagtttcgtcgtgcccatactgctgaaggccctctatatgttaactacacggggtcgccagaccactaaagacaataaggggacaagaatcaggtttaaagatgacagctccttcgaagacattaacggaatccggaagcctaagcatctgtacgtttctcttccaaatgctcaatcgtcaatgaaagccgaggaaattacccccggccgctatcgaacggcgatctgcggcttgtaccctgcacagataaaggccagacagatgattagcccagtgatgagtgtcatcgggtttctggctctagccaaagattggtccgacaggattgagcagtggctctctgaaccctgtaagctgcttcctgatactgcagctgtgagcctgcacggaggtccagccaccaaccgggactatttgcgtcaacgccaggtagcgctcggcaatatggagacaaaagagtccaaggccatcagacagcatgcagaaactgctgggtgctcaatgatcgaggatattgaaagtccgagctctatatgggttttcgccggagctcccgacaggtgtcctccaacctgcctgtttatcgccggcattgcagagttaggtgccttcttttccatcctgcaagatatgcggaacacaataatggcttcaaaaaccgtggggacgagcgaagagaagctccgaaagaaaagttctttctaccagtcctaccttcgcagaactcagagcatgggcattcagctggaccaaaggatcatcgtcttgtttatggtggcgtggggaaaggaggcagtggataatttccacctaggcgacgatatggaccccgaactgcggacactcgcccagtcgctgattgacgtcaaagttaaggagatctctaaccaggaacctcttaaactgtga

SEQ ID NO: 5701 - RNA, 1290 nt, synthetic construct
  misc_feature 1..1290: note = derived and/or modified CDS sequence (opt3) from HTNV__AB027523.1__N
  source 1..1290: mol_type = other RNA
atggccaccatggaggaactgcagaaggagatcaacgctcacgaaggccaactcattatagcaaaacagaaggtgaaagacgccgagaagcagtacgaaaaagatcccgacgagcttaataagagagcgctgacagatagggagggggtcagcgcttccatccaggccaagattgacgaattgaaacggcaattagcagatcgcatcgccactggaaagaacctgggtcaggaccgagatcctacgggcgttgagccaggggaccatctaaaagaacgttctatgctctcatatggaaatattctggatcttaaccacctggacatcgatgagccgaccggccagacagctgactggttgagtataatcgtgtacctcactagcttcgtagtgcccattctgctgaaggcactctatatgttaaccacaagaggtaggcagaccgccaaagataataaggggactcggatccgctttaaggacgactcctctttcgaggatgtcaacggaattagaaaacctaagcatctgtacgtgtcgatgccaaatgctcaatcaagcatgaaagccgaagagatcacacccggcggctataggaccgcggtttgcgggctttttcctgcacagataaaggcccggcagatggtgagtccagtcatgtccgtgattggattcatggctttggccaaagactggacggatcgcatcgaatcttggctgggtgagccctgtaagctactccctgacactagcgcagtatccctgcttggcgggccagctaccaaccgagattacattagacagaggcaagttgccctgggaaatatggaaacaaaagaggcgaaggccgtgcggcagcacgcagagtcagctggctgcagtatgatcgacaacatcgatagcccgtcttccatttgggtctttgccggtgctcccgaccgttgtcctccaacttgcttgttcatagccgggatcgcagaactcggagcctttttctcaattctgcaggatatgcgcaataccatcatggctagcaagacagtgggcaccagtgaggagaaaatgagaaagaaatcttccttttatcaaagctacttaaggcggacgcagtcgatgggcatacagctggaccagcgaattatcgtcctcttcatggtggcgtgggggaaggaagcagccgataactttcaacatggagacgacatggatcccgaacttcgcactctggctcagtctttgatcgaccagaaagttaaggagatttccaatcaggagcctctaaagctgtga

SEQ ID NO: 5702 - RNA, 1293 nt, synthetic construct
  misc_feature 1..1293: note = derived and/or modified CDS sequence (opt3) from HTNV__D25530.1__N
  source 1..1293: mol_type = other RNA
atgatggccaccatggaggaactgcagagagagatcaacgctcacgaaggccaactcgtgattgcaaggcagaaggtccgggacgccgagaaacagtacgaaaaggatcccgacgagcttaataaacgcgcgctgacaaaccgagagggggttgctgtgagcatacaggccaagatcgatgaattgaaaatgcaattagcagaccgtattgccactggaaagaatctgggtaaggagcaggatcctacgggcgtagaaccaggggaccatctaaaagagagatccatgctctcttatggaaacgtgctggatcttaatcacctggacatcgatgagccgaccggccagacagctgactggttgtcaattatcgtctacctcaccagtttcgtggttcccatactgctgaaggcactctatatgttaactacaaggggtcggcagaccactaaagataacaaggggacacgcatcagatttaaagacgatagctccttcgaagacgtgaatggaattaggaagcctaagcatctgtacgtctctcttccaaacgcccaatcgtcaatgaaagctgaggaaatcacccccggccggtatcgcacggccgtgtgcggcttgtaccctgcgcagattaaggcacgacagatgatcagcccagtaatgagtgttatagggtttctggccctagctaaagactggtccgatagaattgagcagtggctcatcgaaccctgtaagctgcttcctgacactgccgcagtgtctctgttgggaggtccagctaccaatagggattatctccggcaacgtcaggtcgccctgggcaacatggagacaaaagagagcaaggcgattcgccagcacgccgaagcagctgggtgctccatgatcgaggacatcgaatcaccgagtagcatttgggtgttcgccggagctcccgatagatgtcctccaacttgcttatttatagccggcatcgcagagctgggtgccttcttttctattctccaagacatgaggaataccatcatggcttccaaaacagtggggacctcagaagagaagctgcggaagaaaagcagtttctaccagtcttaccttcgacgcacgcagtccatgggaatacagttggatcaaagaattatcgtcctatttatggttgcgtggggcaaggaggcagtggacaacttccatctgggcgatgacatggatcccgaactcaggactctggcccagagccttatcgacgtaaaagtgaaggagatttcgaatcaggaacctctgaaattgtga

SEQ ID NO: 5703 - RNA, 1290 nt, synthetic construct
  misc_feature 1..1290: note = derived and/or modified CDS sequence (opt3) from HTNV__M14626.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggtgagcatacaggctaagatcgacgaattgaaacgtcaattagccgatagaattgcaacgggaaagaacctgggtaaggagcaggaccctaccggcgtagaaccaggggatcatctaaaagagaggtccatgctctcttatggaaatgtgctggaccttaaccacctggatatcgacgagccgacaggccagactgccgattggttgtcaattatcgtctacctcaccagtttcgtggttcccatactgctgaaggctctctatatgttaacaacccggggtcgccagactacaaaagacaataaggggaccagaatcaggtttaaagatgacagctccttcgaagacgtgaacggcattcggaagcctaagcatctgtacgtctctcttccaaatgcacaatcgtcaatgaaagccgaggaaatcacgcccggacgctatcgaactgctgtgtgcggcttgtaccctgcccagattaaggcgagacagatgatcagcccagtaatgagtgttatagggtttctggcactagccaaagattggtccgacaggattgagcagtggctcatcgaaccctgtaagctgcttcctgataccgctgccgtgtctctgttgggaggtccagcaacaaaccgggactatctccgtcaacgccaggtcgctctgggcaatatggagactaaagagagcaaggccattagacagcacgcggaagccgcagggtgctccatgatcgaggatatcgaatcaccgagtagcatttgggtgttcgctggagcccccgacaggtgtcctccaacctgcttatttatagctggcatcgccgagctgggtgcattcttttctattctccaagatatgcggaacacaatcatggcctccaaaaccgtggggacgtcagaagagaagctgcgaaagaaaagcagtttctaccagtcttaccttcgcagaactcagtccatgggaatacagttgggccaaaggattatcgtcctatttatggttgcttggggcaaggaggcggtggacaatttccatctgggggatgacatggatcccgaactccggacactggcacagagccttatcgacgtaaaagtgaaggagatttcgaaccaggaacctctgaaattgtga

SEQ ID NO: 5704 - RNA, 1290 nt, synthetic construct
  misc_feature 1..1290: note = derived and/or modified CDS sequence (opt3) from HTNV__X95077.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggtgagcatacaggctaagatcgacgaattgaaacgtcaattagccgatagaattgcaacgggaaagaacctgggtaaggagcaggaccctaccggcgtagaaccaggggatcatctaaaagagaggtccatgctctcttatggaaatgtgctggaccttaaccacctggatatcgacgagccgacaggccagactgccgattggttgtcaattgtcgtgtacctcaccagtttcgttgtgcccacactgctgaaggctctctatatgttaaccactcggggtcgccagacaaccaaagacaataaggggacgagaatcaggtttaaagatgacagctccttcgaagacgtcaacggaatacggaagcctaagcatctgtacgtgtctcttccaaatgcacaatcgtcaatgaaagccgaggaaatcactcccggccgctatcgaaccgctgtatgcggcttgtaccctgcccagattaaggcgagacagatgatcagcccagttatgagtgtgattgggtttctggcactagccaaagattggtccgacaggatcgagcagtggctctctgaaccctgtaagctgcttcctgatacaactgctgtcagcctgttgggaggtccagccaccaaccgggactatctccgtcaacgccaggtggcactgggcaatatggagacaaaagagtccaaggctataagacagcacgccgaagcggccgggtgctcaatgattgaggatatcgaaagtccgagctctatttgggtgttcgcaggagctcccgacaggtgtcctccaacctgcttatttatcgccggcatcgctgagctgggtgccttcttttccattctccaagatatgcggaacacgataatggcatcaaaaactgtcgggacaagcgaagagaaacttcgaaagaagagttctttctaccagtcctacctgcgcagaacccagagcatgggaatccagttggaccaaaggattatcgttctatttatggtggcctggggcaaggaggctgtagataatttccatctgggcgacgatatggaccccgaactccggactctggcgcagtcgcttatagacgtgaaagtcaaggagatttctaaccaggaacctctgaaattgtga

SEQ ID NO: 5705 - RNA, 1290 nt, synthetic construct
  misc_feature 1..1290: note = derived and/or modified CDS sequence (opt3) from HTNV(CGAa1011)__EF990913.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctggatgtgtctcttccaaatgcccaatcgtcaatgaaagctgaggaaatcacgcccggacgctaccgaactgccatttgcggcttgtatcctgcgcagatcaaggcaagacagatgataagcccagtcatgagtgtgattgggtttctggccctagctaaagactggtccgataggatcgagcagtggctcggagaaccctgtaagctgcttcctgacaccgccgcagtatctctgttgggtggcccagctacaaaccgggattacctccgtcaacgccaggttgccctggggaatatggagactaaagagagcaaggcgattagacagcacgccgaaaccgcaggatgctccatgatcgaggacatcgaatcaccgagtagcatttgggtgttcgctggcgcccccgataggtgtcctccaacatgcttatttatagctggtatcgccgagctgggggcattcttttctgtcctccaagacatgcggaacaccattatggcctccaaaacggtgggaacttcagaagagaagctgcgaaagaaaagcagtttctatcagtcttaccttggccgcacacagtccatgggcatccagttggatcaaagaataattgtgctatttatggtcgcttgggggaaggaggcggttgacaatttccatctgggagatgacgtggaccccgaactcaggaccctggcacagagccttatcgatgtaaaagtgaaggagatctcggaccaggaacctctgaaattgtga

SEQ ID NO: 5706 - RNA, 1290 nt, synthetic construct
  misc_feature 1..1290: note = derived and/or modified CDS sequence (opt3) from HTNV(CGAa1015)__EF990912.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctggatgtgtctcttccaaatgcccaatcgtcaatgaaagctgaggaaatcacgcccggacgctaccgaactgccatttgcggcttgtatcctgcgcagatcaaggcaagacagatgataagcccagtcatgagtgtgattgggtacctggccctagctaaagactggtccgataggatcgagcagtggctcggagaaccctgtaagctgcttcctgacaccgccgcagtatctctgttgggtggcccagctacaaaccgggattatctccgtcaacgccaggttgccctggggaatatggagactaaagagagcaaggcgattagacagcacgccgaaaccgcaggatgctccatgatcgaggacatcgaatcaccgagtagcatttgggtgtttgctggcgcccccgataggtgtcctccaacatgcttattcatagctggtatcgccgagctgggggcatttatttctgtcctccaagacatgcggaacaccatcatggcctccaaaacggtgggaacttcagaagagaagctgcgaaagaaaagcagtttctaccagtcttaccttggccgcacacagtccatgggcatacagttggatcaaagaattatcgtgctatttatggtcgcttgggggaaggaggcggttgacaatttccatctgggagatgacgtggaccccgaactcaggaccctggcacagagccttatcgatgtaaaagtgaaggagatttcggaccaggaacctctgaaattgtga

SEQ ID NO: 5707 - RNA, 1290 nt, synthetic construct
  misc_feature 1..1290: note = derived and/or modified CDS sequence (opt3) from HTNV(CGAa2)__EU092219.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctgtacgtgtctcttccaaatgcccaatcgtcaatgaaagctaaggagatcacgcccggacgctatcgaactgccatttgcggcttgtaccctgcgcagatcaaagcaagacagatgataagcccagtcatgagtgtgattgggtttctggccctagctaaggattggtccgacaggatcgaacagtggctctctgagccctgtaaactgcttcctgataccgccgcagtaagcctgcacggaggtccagctacaaaccgggactatttgcgtcaacgccaggttgccctcggcaatatggaaccgaaggagtccaaagcgattagacagcatgccgagtcagcagggtgcagtatggtggaagatatcgagagcccctcttccatctgggtcttcgctggagcccctgacaggtgtccacccacttgcctgtttattgctggcatagccgaattaggtgcattcttttcaatcctgcaagatatgcggaacaccattatggccagcaagacagtggggaccagtgaggaaaagctccgcaaaaagtcttccttctaccagagctaccttcgaagaacgcagtcgatgggaatccagctggaccaaaggataattgtgttgtttatggtcgcttggggcaaagaggcggttgataatttccacctaggcgacgatatggaccctgagctgcggactctcgcacagtctctgatcgacgtgaaggtaaaagaaatctccaaccaggagccacttaagctgtga

SEQ ID NO: 5708 - RNA, 1290 nt, synthetic construct
  misc_feature 1..1290: note = derived and/or modified CDS sequence (opt3) from HTNV(CGAa31MP7)__EF990911.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctgtacgtgtctcttccaaatgcccaatcgtcaatgaaagctgaggaaatcacgcccggacgctatcgaactgccatttgcggcttgtaccctgcgcagatcaaggcaagacagatgataagcccagtcatgagtgtgattgggtttctggccctagctaaagattggtccgacaggatcgagcagtggctctctgaaccctgtaagctgcttcctgataccgccgcagtaagcctgcacggaggtccagctacaaaccgggactatttgcgtcaacgccaggttgccctcggcaatatggagactaaagagtccaaggcgattagacagcatgccgaatcagcagggtgcagtatggtggaggatatcgaaagcccgtcttccatctgggtcttcgctggagcccccgacaggtgtcctccaacctgcctgtttattgctggcatagccgagttaggtgcattcttttcaatcctgcaagatatgcggaacacaattatggccagcaaaaccgtggggacgagtgaagagaagctccgaaagaaatcttccttctaccagagctaccttcgcagaactcagtcgatgggaatccagctggaccaaaggataattgtgttgtttatggtcgcttggggcaaggaggcggttgataatttccacctaggcgacgatatggaccccgaactgcggacactcgcacagtctctgatcgacgtgaaagtaaaggagatctccaaccaggaacctcttaaactgtga

SEQ ID NO: 5709 - RNA, 1290 nt, synthetic construct
  misc_feature 1..1290: note = derived and/or modified CDS sequence (opt3) from HTNV(CGAa31P9)__EF990910.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctgtacgtgtctcttccaaatgcccaatcgtcaatgaaagctgaggaaatcacgcccggacgctatcgaactgccatttgcggcttgtaccctgcgcagatcaaggcaagacagatgataagcccagtcatgagtgtgattgggtttctggccctagctaaagattggtccgacaggatcgagcagtggctctctgaaccctgtaagctgcttcctgataccgccgcagtaagcctgcacggaggtccagctacaaaccgggactatttgcgtcaacgccaggttgccctcggcaatatggagactaaagagtccaaggcgattagacagcatgccgaatcagcagggtgcagtatggtggaggatatcgaaagcccgtcttccatctgggtcttcgctggagcccccgacaggtgtcctccaacctgcctgtttattgctgagatagccgaattaggcgcattcttttcaatcctgcaagatatgcggaacacaattatggccagcaaaaccgtgggtacgagtgaggagaagctccgaaagaaatcttccttctaccagagctaccttcgcagaactcagtcgatggggatccagctggaccaaaggataattgtgttgtttatggtcgcttggggaaaggaagcggttgataatttccacctaggcgacgatatggaccccgagctgcggacactcgcacagtctctgatcgacgtgaaagtaaaggaaatctccaaccaggagcctcttaaactgtga

SEQ ID NO: 5710 - RNA, 1290 nt, synthetic construct
  misc_feature 1..1290: note = derived and/or modified CDS sequence (opt3) from HTNV(CGAa4MP9)__EF990915.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctgtacgtgtctcttccaaatgcccaatcgtcaatgaaagctgaggaaatcacgcccggacgctatcgaactgccatttgcggcttgtaccctgcgcagatcaaggcaagacagatgataagcccagtcatgagtgtgattgggtttctggccctagctaaagattggtccgacaggatcgagcagtggctcggagaaccctgtaagctgcttcctgataccgccgcagtatctctgttgggtggcccagctacaaaccgggactatctccgtcaacgccaggttgccctggggaatatggagactaaagagagcaaggcgattagacagcacgccgaaaccgcaggatgctccatgatcgaggatatcgaatcaccgagtagcatttgggtgttcgctggcgcccccgacaggtgtcctccaacatgcttatttatagctggtatcgccgagctgggggcattcttttctgtcctccaagatatgcggaacaccattatggcctccaaaacggtgggaacttcagaagagaagctgcgaaagaaaagcagtttctaccagtcttaccttcgcagaacacagtccatgggcatccagttggaccaaaggataattgtgctatttatggtcgcttggggcaaggaggcggttgataatttccatctgggggacgatatggaccccgaactccggaccctggcacagagccttatcgacgtgaaagtaaaggagatctcgaaccaggaacctctgaaattgtga

SEQ ID NO: 5711 - RNA, 1290 nt, synthetic construct
  misc_feature 1..1290: note = derived and/or modified CDS sequence (opt3) from HTNV(CGAa75)__EU092220.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtagcgtcgtgcccatactgctgaaggcactctatatgttaacaacccggggtcgccagactacaaaagacaataaggggaccagaatcaggttcaaagatgactcctcttttgaagacgttaacggcattcggaagcctaagcatctgtacgtgtcgcttccaaatgcccaatcaagcatgaaagctgaggaaatcacgcccggacgctatcgaactgccatttgcggcttgtaccctgcgcagatcaaggcaagacagatgataagtccagtcatgaacgtgattgggttcctggccctagctaaagattggtccgacaggatcgagcagtggctctctgaaccctgtaagctgcttcctgataccgccgcagtaagcctgcacggaggtccagctacaaatcgggactatttgcgtcaacgccaggttgccctcggcaacatggagactaaagagtccaaggcgattagacagcatgccgaatcagcagggtgcagtatggtggaggatatcgaaagcccgtcttccatctgggtctttgctggagcccccgacaggtgtcctccaacctgcctgttcattgctggcatagccgagttaggtgcatttttctcaatcctgcaagatatgcggaatacaattatggccagcaaaaccgtggggacgagtgaagagaagctccgaaagaaatcttccttttaccagagctaccttcgcagaactcagtcgatgggaatccagctggaccaaaggataattgtgttgttcatggtcgcttggggcaaggaggcggttgataactttcacctaggcgacgatatggaccccgaactgcggacactcgcacagtctctgatcgacgtgaaagtaaaggagatctccaatcaggaacctcttaaactgtga

SEQ ID NO: 5712 - RNA, 1290 nt, synthetic construct
  misc_feature 1..1290: note = derived and/or modified CDS sequence (opt3) from HTNV(CGHu1)__EU092218.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatagcgacgagcttaataaacgcacactgactgatcgagagggggttgcggtgtccatacaggctaagatcgacgaattgaaacgtcaattagccgatagaattgcaacgggaaagaacctgggtaaggagcaggaccccaccggcgtagaacctggggatcatctaaaagagaggtctatgctctcatatggaaatgtgctggaccttaaccacctggatatcgacgagccaacaggccagactgccgattggttgagtattgtcgtgtacctcaccagcctggttgtgccgatcctgctcaaggctttatatatgctgacaaccaaaggtcggcagactacaaaggacaataaagggacccgcataagattcaaggatgactcctcttttgaagacgtcaacggaatcaggaagcccaaacatctttacgtgtcgttgctgaatgcacaatcaagcatgaaggccgaggaaattacgcctggccggtatcgcactgctatctgcggcccataccccgcccagattaaagcgcgacagatgatcagtcctgtaatgtccgttatagggttcctagcactcgccaaggattggtctgacagaattgagcagtggctgagcgaaccatgtaaacttctgcccgataccgctgccgtgtccttgctcggaggtcctgcaacaaacagggactatctgcggcaacgtcaggtcgctttaggcaatatggagactaaggagtcaaaagccatccgccagcacgcggaagccgcagggtgcagtatgattgaggatatcgaaagcccatcttccatctgggtgtcagctggagccccggacagatgtccccctacctgcctgtttattgctggcatagccgagctcggtgcattctttagcatccttcaagatatgaggaacacaattatggccagtaagaccgtggggacgtctgaagagaagctgcggaaaaagtccagcttctaccagtcgtacttgcgacgcactcagtctatgggaatccagctagaccaaagaataattgtcctgtttatggttgcttggggcaaagaggcggtggataatttccatctcggcgacgatatggacccagaactgaggacacttgcacagtccctgatcgacgtaaaggtgaaagagatctcaaaccaggaacccttgaagctctga

SEQ ID NO: 5713 - RNA, 1290 nt, synthetic construct
  misc_feature 1..1290: note = derived and/or modified CDS sequence (opt3) from HTNV(CGHu2)__EU363813.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtctggtcgtgcccatactgctcaaggcattatatatgctgacaacccggggtcgccagactacaaaagacaataaggggaccagaatcaggttcaaagatgacagctcctttgaagacgttaacggcattcggaagcctaagcatctttacgtgtctttgccaaatgcccaatcgtcaatgaaagctgaggaaatcacgcccggacgctatcgaactgccatttgcggcctgtaccctgcgcagatcaaggcaagacagatgataagcccagtcatgagtgtgattgggttcctagccctcgctaaagattggtccgacaggatcgagcagtggctgtctgaaccctgtaagttgctgcctgataccgccgcagtaagccttcacggaggtccagctacaaaccgggactatctccgtcaacgccaggttgccctgggcaatatggagactaaagagtccaaggcgattagacagcatgccgaatcagcagggtgcagtatggtggaggatatcgaaagcccgtcttccatctgggtctttgctggagcccccgacaggtgtcctccaacctgcttattcattgctggcatagccgagctgggtgcatttttctcaatcagccaagatatgcggaacacaattatggccagtaaaaccgtggggacgtctgaagagaagctccgaaagaaatccagcttttaccagtcgtaccttcgcagaactcagtctatgggaatccagctggaccaaaggataattgtgttgttcatggtcgcttggggcaaggaggcggttgataattttcacctaggcgacgatatggaccccgaactgcggacactcgcacagtccctgatcgacgtgaaagtaaaggagatctcaaaccaggaacctcttaaactgtga

SEQ ID NO: 5714 - RNA, 1290 nt, synthetic construct
  misc_feature 1..1290: note = derived and/or modified CDS sequence (opt3) from HTNV(CGHu3612)__EF990909.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagaggggttggctgccagcatacaggcaaagatcgacgaattaaaacgtcaactggccgatagagttgctactggaaagaacctaggtaaggagcaggaccctacgggcgtggaaccaggggatcatctcaaagagaggtccatgctgtcttatggaaatgtacttgacctgaaccacttggatattgacgagccgaccggccagacagcagattggctctcaatcgtgatttacctgactagcttcgtcgtgcccatcctgctcaaggccttatatatgctgaccacacggggtcgccagaccactaaagacaataaggggacaagaataaggtttaaagatgacagctccttcgaagacgttaacggaatccggaagcctaagcatctttacgtgtctttgccaaatgctcaatcgtcaatgaaagccgaggaaattacccccggccgctatcgaacggcgatctgcggcctgtaccctgcacagattaaggccagacagatgatcagcccagtcatgagtgtgatagggtttctagctctcgccaaagattggtccgacaggattgagcagtggctgtctgaaccctgtaaacttctgcctgatactgcagctgtaagtttgcacggaggtccagccaccaaccgggactatctccgtcaacgccaggttgcgctgggcaatatggagacaaaggagtccaaggccatcagacagcatgcagaatcagctgggtgcagtatggtggaggatattgaaagcccgtcttccatctgggtcttcgccggagctcccgacaggtgtcctccaacttgcttatttatcgccggcattgcagagctgggtgccttcttttcaatactccaagatatgcggaacaccatcatggctagcaaaacagtggggaccagtgaagagaaacttcgaaagaagtcttccttctaccagagctacctgcgcagaacgcagtcgatgggcattcagttggaccaaaggatcatagtgctatttatggtcgcgtggggaaaggaggcagttgataatttccacctgggcgacgatatggaccccgaactccggactctggcccagtctcttattgacgtgaaagtacgcgagatctccaaccaggaacctctgaagttgtga

SEQ ID NO: 5715 - RNA, 1290 nt, synthetic construct
  misc_feature 1..1290: note = derived and/or modified CDS sequence (opt3) from HTNV(CGRn15)__EU363810.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctgtacgtgacgcttccaaatgcccaatcttcgatgaaagctgaggaaatcactcccggacgctatcgaaccgccatttgcggcttgtaccctgcgcagatcaaggcaagacagatgatatcaccagtcatgagcgtgattgggtttctggccctagctaaagattggagtgacaggatcgagcagtggctctccgaaccctgtaagctgcttcctgatacagccgcagtatctctgcacggaggtccagctactaaccgggactatttgcgtcaacgccaggttgccctcggcaatatggagaccaaagagagcaaggcgattagacagcatgccgaatccgcagggtgctcaatggtggaggatatcgaaagtccgagctctatctgggtcttcgctggagcccccgacaggtgtcctccaacatgcctgtttattgctggcatagccgagttaggtgcattcttttccatcctgcaagatatgcggaacaccattatggcctcaaaaacggtggggactagcgaagagaagctccgaaagaaaagttctttctaccagtcctaccttcgcagaacacagagcatgggaatccagctggaccaaaggataattgtgttgtttatggtcgcttggggcaaggaggcggttgataatttccacctaggcgacgatatggaccccgaactgcggaccctcgcacagtcgctgatcgacgtgaaagtaaaggagatctctaaccaggaacctcttaaactgtga

SEQ ID NO: 5716 - RNA, 1290 nt, synthetic construct
  misc_feature 1..1290: note = derived and/or modified CDS sequence (opt3) from HTNV(CGRn2616)__EU363811.1__N
  source 1..1290: mol_type = other RNA
atggccaccatggaggaactgcagagagagatcaacgctcacgaaggccaactcgtgattgcaaggcagaaggtccgggacgccgggaaacagtacgagaaggatcccgacgaacttaataaacgcacactgactgatcgagagggagttgcggctagcatacaggccaagatcgacgagttgaaacgtcaattagcagatagaattgccacgggtaagaacctgggcaaggaacaggaccctaccggggtggagccaggagatcatctaaaagaaaggtccatgctctcttatggcaatgtactggaccttaaccacctggatatcgacgagccgacaggtcagactgctgattggttgtcaattgtgatctacctcaccagtttcgtcgtgcccatactgctgaaggcactctatatgttaacaacccgggggcgccagactacaaaagacaataagggaaccagaatcaggtttaaagatgacagctccttcgaggacgttaacggcattcggaagcctaagcatctgtacgtgtctcttccaaatgcccaatcgtcaatgaaagctgaagagatcacgcccggccgctatcgaactgccatttgcgggttgtaccctgcgcagatcaaggcaagacagatgataagcccagtcatgagtgtgattggatttctggccctagctaaagattggtccgacaggatcgaacagtggctctctgagccctgtaagctgcttcctgataccgccgcagtaagcctgcacggtggcccagctacaaaccgggactatttgcgtcaacgccaggttgccctcgggaatatggaaactaaagagtccaaggcgattagacagcatgccgagtcagcaggatgcagtatggtggaagatatcggcagcccgtcttccatctgggtcttcgctggtgcccccgacaggtgtcctccaacctgcctgtttattgctgggatagccgagttaggagcattcttttcaatcctgcaagatatgcggaacacaattatggccagcaaaaccgtgggcacgagtgaagagaagctccgaaagaaatcttccttctaccagagctaccttcgcagaactcagtcgatgggcatccagctggaccaaaggataattgtgttgtttatggtcgcttgggggaaggaagcggttgataatttccacctaggagacgatatggaccccgagctgcggacactcgcacagtctctgatcgacgtggaggtaaaagaaatctccaaccaggagcctcttaagctgtga

SEQ ID NO: 5717 - RNA, 1290 nt, synthetic construct
  misc_feature 1..1290: note = derived and/or modified CDS sequence (opt3) from HTNV(CGRn53)__EF990907.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtgatctacctcaccagtttcgtcgtgcccatactgctgaaggccctctatatgttaactacacggggtcgccagaccactaaagacaataaggggacaagaatcaggtttaaagatgacagctccttcgaagacgttaacggcattcggaagcctaagcatctgtacgtgtctcttccaaatgctcaatcgtcaatgaaagccgaggaaatcacccccggacgctatcgaacggcgatttgcggcttgtaccctgcacagatcaaggccagacagatgataagcccagtcatgagtgtgattgggtttctggctctagccaaagattggtccgacaggatcgagcagtggctctctgaaccctgtaagctgcttcctgatactgcagctgtaagcctgcacggaggtccagccaccaaccgggactatttgcgtcaacgccaggttgcgctcggcaatatggagacaaaagagtccaaggccattagacagcatgcagaagctgccgggtgctcaatgatcgaggatatcgaaagtccgagctctatttgggtgttcgctggagcccccgacaggtgtcctccaacttgcctgtttatagcaggcatcgccgagttaggtgctttcttttccattctgcaagatatgcggaacaccatcatggcgtcaaaaacagtcgggaccagcgaagagaagctccgaaagaaaagttctttctaccagtcctaccttcgcagaacgcagagcatgggaatacagctggaccaaaggattatcgtgttgtttatggtggcatggggcaaggaggccgtcgataatttccacctaggcgacgatatggaccccgaactgcggactctcgctcagtcgctgatcgacgttaaagtgaaggagatttctaaccaggaacctcttaaactgtga

SEQ ID NO: 5718 - RNA, 1290 nt, synthetic construct
  misc_feature 1..1290: note = derived and/or modified CDS sequence (opt3) from HTNV(CGRn5310)__EF990906.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcctaataaacgcgcgcttacagatcgagagggggttgctgccagcatacaggcaaagatcgacgaactgaaacgtcaattggccgatagaattgctactggaaagaacttaggtaaggagcaggacccaacgggcgtggaaccgggggatcatctgaaagagaggtccatgctatcttatggaaatgtactcgacctgaaccaccttgatatcgacgagcccaccggccagacagcagattggctgtcaattgtgatctacttgaccagtttcgtcgtgcctatactcctgaaggccctgtatatgctcactacacggggtcgccagaccactaaagacaataaggggacaagaatcaggtttaaagatgacagctccttcgaagacgttaacggcattcggaagccaaagcatttatacgtgtctctgcccaatgctcaatcgtcaatgaaagccgaggaaatcacccctggacgctatcgaacggcgatttgcggcctttacccagcacagatcaaggccagacagatgataagccccgtcatgagtgtgattgggtttttggctctggccaaagattggtccgacaggatcgagcagtggctatctgaaccttgtaagctcctgccagatactgcagctgtaagccttcacggaggtccggccaccaaccgggactatctgcgtcaacgccaggttgcgttgggcaatatggagacaaaagagtccaaggccattagacagcatgcagaagctgccgggtgctcaatgatcgaggatatcgaaagtcccagctctatttgggtgttcgctggagcccctgacaggtgtccacccacttgcctctttatagcaggcatcgccgagctgggtgctttcttttccattttacaagatatgcggaacaccatcatggcgtcaaaaacagtcgggaccagcgaagagaagctgcgaaagaaaagttctttctaccagtcctacctccgcagaacgcagagcatgggaatacagcttgaccaaaggattatcgtgctgtttatggtggcatggggcaaggaggccgtcgataatttccacttgggcgacgatatggaccctgaactacggactctggctcagtcgctcatcgacgttaaagtgaaggagatttctaaccaggaaccactgaaactttga

SEQ ID NO: 5719 - RNA, 1290 nt, synthetic construct
  misc_feature 1..1290: note = derived and/or modified CDS sequence (opt3) from HTNV(CGRn93MP8)__EF990905.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgcccctatacaggcaaagatcgacgaattgaaacgtcaattagccgatagaattgctactggaaagaacctgggtaaggagcaggacccaacgggcgtggaaccgggggatcatctaaaagagaggagcatgctctcctatggaaatgtactggaccttaaccacctggatatcgacgagcccaccggccagacagcagattggttgtctattgtgatctacctcacttcattcgtcgtgcctatactgctgaaggccctctatatgttaaccacacggggtcgccagaccactaaagacaataaggggagtagaatcaggtttaaagatgacagctccttcgaagacgttaacggcattcggaagccaaagcatctgtacgtgtctcttcccaatgctcaatcgtcaatgaaagccgaggaaatcacacctggacgctatcgaaccgcgatttgcggcttgtacccagcacagatcaaggccagacagatgataagccccgtcatgagtgtgattgggtttctggctctagccaaagattggtccgacaggatcgagcagtggctctctgaaccttgtaagctgcttccagatacggcagctgtaagcctgcacggaggtccggccactaaccgggactatttgcgtcaacgccaggttgcgctcggcaatatggagaccaaagagtccaaggccattagacagcatgcagaagctgccgggtgctcaatgatcgaggatatcgaaagtcccagctctatttgggtgttcgctggagcccctgacaggtgtccacccacatgcctgtttatagcaggcatcgccgagttaggtgctttcttttccattctgcaagatatgcggaacactatcatggcgtcaaaaaccgtcgggacaagcgaagagaagctccgaaagaaaagttctttctaccagtcctaccttcgcagaacccagagcatgggaatacagctggaccaaaggattatcgtgttgtttatggtggcatggggcaaggaggccgtcgataatttccacctaggcgacgatatggaccctgaactgcggacgctcgctcagtcgctgatcgacgttaaagtgaaggagatttctaaccaggaaccacttaaactgtga

SEQ ID NO: 5720 - RNA, 1290 nt, synthetic construct
  misc_feature 1..1290: note = derived and/or modified CDS sequence (opt3) from HTNV(CGRn93P8)__EF990904.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtgatctacctcaccagtttcgtcgtgcccatactgctgaaggccctctatatgttaactacacggggtcgccagaccactaaagacaataaggggacaagaatcaggtttaaagatgacagctccttcgaagacgttaacggcattcggaagcctaagcatctgtacgtgtctcttccaaatgctcaatcgtcaatgaaagccgaggaaatcacccccggacgctatcgaacggcgatttgcggcttgtaccctgcacagatcaaggccagacagatgataagcccagtcatgagtgtgattgggtttctggctctagccaaagattggtccgacaggatcgagcagtggctctctgaaccctgtaagctgcttcctgatactgcagctgtaagcctgcacggaggtccagccaccaaccgggactatttgcgtcaacgccaggttgcgctcggcaatatggagacaaaagagtccaaggccattagacagcatgcagaagctgccgggtgctcaatgatcgaggatatcgaaagtccgagctctatttgggtgttcgctggagcccccgacaggtgtcctccaacttgcctgtttatagcaggcatcgccgagttaggtgctttcatttccatcctgcaagatatgcggaacaccataatggcgtcaaaaacagtcgggaccagcgaagagaagctccgaaataagagttctttttaccagtcctaccttcgcagaacgcagagcatgggcattcagctggaccaaaggatcatcgtgttgttcatggtggcatggggaaaagaggccgtcgataactttcacctaggcgacgatatggaccccgaactgcggactctcgctcagtcgctgattgacgttaaggtgaaagagatctctaatcaggaacctcttaagctgtga

SEQ ID NO: 5721 - RNA, 1290 nt, synthetic construct
  misc_feature 1..1290: note = derived and/or modified CDS sequence (opt3) from HTNV(CGRni1)__EU363812.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtagggagcaggaccctaccggcgtggaaccaggggatcatctaaaggagcggtccatgctctcttatggaaatgtactggaccttaaccacctggatatcgacgagccgacaggccagactgctgattggttgtcaattgtgatctacctcaccagtttcgtcgtgcccatactgctgaaagcactctatatgttaacaacccgcggtagacagactacaaaggacaataaagggaccaggatccggtttaaggatgacagctccttcgaagacattaacggaatccgcaaacctaagcatctgtacgtttctcttccaaatgcccaatcgtcaatgaaggctgaggaaattacgcccggccgatatagaactgccatctgcggcttgtaccctgcgcagataaaagcaaggcagatgattagcccagtgatgagtgtcatcgggtttctggccctagctaaggattggtccgaccggattgagcagtggctctctgaaccctgtaaactgcttcctgataccgccgcagtgagcctgcacggaggtccagctacaaaccgtgactatttgcgccaaagacaggtagccctcggcaatatggagactaaggagtccaaagcgatcaggcagcatgccgaatcagcagggtgcagtatggttgaggatatcgaaagcccgtcttccatttgggtgttcgctggagcccccgaccggtgtcctccaacctgcctgtttatagctggcatcgccgagttaggtgcattcttttcaattctgcaagatatgcgaaacacaatcatggccagcaagaccgtcgggacgagtgaagagaaactccgcaagaagtcttccttctaccagagctaccttagaaggactcagtcgatgggaatacagctggaccaacggattatcgtgttgctaatggtggcttggggcaaagaggcggtcgataattttcacctgggcgacgatatggaccccgaactccgcacactggcacagtctcttatcgacgttaaggtgaaagagatttccaaccaggaacctctgaagttgtga

SEQ ID NO: 5722 - RNA, 1290 nt, synthetic construct
  misc_feature 1..1290: note = derived and/or modified CDS sequence (opt3) from HTNV(CJAp93)__EF208929.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggtgagcatacaggctaagatcgacgaattgaaacgtcaattagccgatagaattgcaacgggaaagaacctgggtaaggagcaggaccctaccggcgtagaaccaggggatcatctaaaagagaggtccatgctctcttatggaaatgtgctggaccttaaccacctggatatcgacgagccgacaggccagactgccgattggttgtcaattgtcgtgtacctcaccagtttcgttgtgcccatcctgctgaaggctctctatatgttaacaacccggggtcgccagactacaaaagacaataaggggaccagaataaggtttaaagatgacagctccttcgaagacgtcaacggaatccggaagcctaagcatctgtacgtgtctcttccaaatgcacaatcgtcaatgaaagccgaggaaattacgcccggccgctatcgaactgctatctgcggcttgtaccctgcccagattaaggcgagacagatgatcagcccagtaatgagtgttatagggtttctggcactagccaaagattggtccgacaggattgagcagtggctctctgaaccctgtaagctgcttcctgataccgctgccgtgggactgttgggtggcccagcaacaaaccgggactatctccgtcaacgccaggtcgctctggggaatatggagactaaagagagcaaggccatcagacagcacgcggaagccgcaggatgctccatgattgaggatatcgaatcaccgagtagcatctgggtgttcgctggcgcccccgacaggtgtcctccaacctgcttatttattgctggtatagccgagctgggggcattcttttctatcctccaagatatgcggaacacaattatggcctccaaaaccgtgggaacgtcagaagagaagctgcgaaagaaaagcagtttctaccagtcttaccttcgcagaactcagtccatgggcatccagttggaccaaaggataattgtcctatttatggttgcttggggcaaggaggcggtgaataacttccatctgggggatgacatggatcccgaactccggacactggcacagagccttatcgacgtaaaagtgaaggagatctcgaatcaggaacctctgaaattgtga

SEQ ID NO: 5723 - RNA, 1290 nt, synthetic construct
  misc_feature 1..1290: note = derived and/or modified CDS sequence (opt3) from HTNV(Aa14_207)__KX687234.1__N
  source 1..1290: mol_type = other RNA
atggccaccatggaggaactgcagagagagatcaacgctcacgaaggccaactcgtgattgcaaggcagaaggtccgggacgccgagaaacagtacgggaaggatcccgacgaacttaataaacgcgcgctgacagatcgagagggagttgctgtgagcatacaggccaagatcgacgagttgaaacgtcaattagcagatagaattgccactggtaagaacctgggcaaggaacaggaccctacgggggtagagccaggagatcatctaaaagaaaggtccatgctctcttatggcaatgtgctggaccttaaccacctggatatcgacgagccgaccggtcagacagctgattggttgtcaattgtcgtgtacctcaccagtttcgttgtgcccatcctgctgaaggcactctatatgttaactacacgggggcgccagaccactaaagacaataagggaacaagaataaggtttaaagatgacagctccttcgaggacgtcaacggcatccggaagcctaagcatctgtacgtgtctcttccaaatgcccaatcgtcaatgaaagctgaagagattacccccggccgctatcgaacggccgtatgcgggttgtaccctgcgcagatcaaggcaagacagatgattagcccagttatgagtgtgatcggatttctggccctagctaaagattggtccgacaggatagaacagtggctctctgagccctgtaagctgcttcctgatactgccgcagtcagcctgttgggtggcccagctaccaaccgggactatctccgtcaacgccaggtggccctggggaatatggaaacaaaagagtccaaggcgattagacagcacgccgaggcagctggatgctcaatgatcgaagatattgagagtccgagctctatctgggtgttcgccggcgctcccgacaggtgtcctccaacttgcttatttgtcgccggtatcgcagaactgggggccttcttttccattctccaagatatgcggaacaccataatggcttcaaaaacagttggaaccagcgaggaaaaacttcgaaagaagagttctttctaccagtcctacctgcgcagaacgcagagcatgggcatccagttggaccaaaggattatcgtgctatttatggtagcgtggggcaaggaggcagtggataatttccatctgggggacgatatggaccccgagctccggactctggcccagtcgcttatagacgtcaaagtgaaggaaatttctaaccaggagcctctgaaattgtga

SEQ ID NO: 5724 - RNA, 1290 nt, synthetic construct
  misc_feature 1..1290: note = derived and/or modified CDS sequence (opt3) from HTNV(Aa14_234)__KX687235.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgtgagcatacaggccaagatcgacgaattgaaacgtcaattagcagatagaattgccactggaaagaacctgggtaaggagcaggaccctacgggcgtagaaccaggggatcatctaaaagagaggtccatgctctcttatggaaatgtgctggaccttaaccacctggatatcgacgagccgaccggccagacagctgattggttgtcaattgtcgtgtacctcaccagtttcgttgtgcccatcctgctgaaggcactctatatgttaactacacggggtcgccagaccactaaagacaataaggggacaagaataaggtttaaagatgacagctccttcgaagacgtcaacggaatccggaagcctaagcatctgtacgtgtctcttccaaatgcccaatcgtcaatgaaagctgaggaaattacccccggccgctatcgaacggccgtatgcggcttgtaccctgcgcagatcaaggcaagacagatgattagcccagttatgagtgtgatcgggtttctggccctagctaaagattggtccgacaggatagagcagtggctcggagaaccctgtaagctgcttcctgatactgccgcagtctctctgttgggtggcccagctaccaaccgggactatctccgtcaacgccaggtggccctggggaatatggagacaaaagagagcaaggcgattagacagcacgccgaagcagctggatgctccatgatcgaggatattgaatcaccgagtagcatctgggtgttcgccggcgctcccgacaggtgtcctccaacttgcttatttatcgccggtattgcagagctgggggccttcttttctatactccaagatatgcggaacaccatcatggcttccaaaacagtcggaacctcagaagagaagctgcgaaagaaaagcagtttctaccagtcttaccttcgcagaacgcagtccatgggcattcagttggaccaaaggatcatagttctatttatggtggcgtggggcaaggaggcagtagataatttccatctgggggacgatatggaccccgaactccggactctggcccagagccttattgacgtgaaagtcaaggagatctcgaaccaggaacctctgaaattgtga

SEQ ID NO: 5725 - RNA, 1290 nt, synthetic construct
  misc_feature 1..1290: note = derived and/or modified CDS sequence (opt3) from HTNV(Aa14_239)__KX687236.1__N
  source 1..1290: mol_type = other RNA
atggccaccatggaggaactgcagagagagatcaacgctcacgaaggccaactcgtgattgcaaggcagaaggtccgggacgccgagaaacaggatgggaaggaccccgatgaacttaataaacgcgcgctgacagaccgagagggagttgctgtgagcatacaggccaagatcgatgagttgaaacgtcaattagcagacagaattgccactggtaagaacctgggcaaggaacaggatcctacgggggtagagccaggagaccatctaaaagaaaggtccatgctctcttacggcaatgtgctggatcttaaccacctggacatcgatgagccgaccggtcagacagctgactggttgtcaattgtcgtgtatctcaccagtttcgttgtgcccatcctgctgaaggcactctacatgttaactacacgggggcgccagaccactaaagataataagggaacaagaataaggtttaaagacgacagctccttcgaggatgtcaacggcatccggaagcctaagcatctgtatgtgtctcttccaaatgcccaatcgtcaatgaaagctgaagagattacccccggccgctaccgaacggccgtatgcgggttgtatcctgcgcagatcaaggcaagacagatgattagcccagttatgagtgtgatcggatttctggccctagctaaagactggtccgataggatagaacagtggctcggtgagccctgtaagctgcttcctgacactgccgcagtctctctgttgggcgggccagctaccaaccgggattacctccgtcaacgccaggtggccctgggaaatatggaaacaaaagagagcaaggcgattagacagcacgccgaggcagctggctgctccatgatcgaagacattgagtcaccgagtagcatctgggtgttcgccggtgctcccgataggtgtcctccaacttgcttatttatcgccgggattgcagaactgggagccttcttttctatactccaagacatgcggaacaccatcatggcttccaaaacagtcggcacctcagaggaaaagctgcgaaagaaaagcagtttctatcagtcttaccttcgcagaacgcagtccatgggcattcagttggatcaaaggatcatagttctatttatggtggcgtgggggaaggaggcagtagacaatttccatctgggagatgacatggaccccgagctccggactctggcccagagccttattgatgtgaaagtcaaggaaatctcgaaccaggagcctctgaaattgtga

SEQ ID NO: 5726 - RNA, 1290 nt, synthetic construct
  misc_feature 1..1290: note = derived and/or modified CDS sequence (opt3) from HTNV(AY133/2011)__KY807166.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacatcggtaaggagcaggaccctacgggcgtggaaccaggggatcatctgaaagagaggtccatgctatcttatggaaatgtactcgacctgaaccaccttgatattgacgagccgaccggccagacagcagattggctgtcaatcgtgatatacttgaccagtttcgtcgtgcccatcctcctgaaggccctgtatatgctcactacacggggtcgccagaccactaaagacaataaggggacaagaattaggtttaaagatgacagctccttcgaagacgtttctggaatccggaagcctaagcatttatacctgtcgcttccaaacgctcaatcaagcatgaaagccgaggaaattacccccggccgctatcgaacggcgatctgcggcttgtaccctgcacagataaaggccagacagatgattagtccagtgatgtccgtcatcgggtttctggctctagccaaagattggtctgacaggattgagcagtggctcagcgaaccctgtaagctgcttcctgatactgcagctgtgtccctgcacggaggtccagccaccaatcgggactatttgcgtcaacgccaggtagcgctcggcaacatggagacaaaagagtcaaaggccatcagacagcatgcagaaactgctgggtgcagtatgatcgatgacattgagagcccgtcttccatatgggttttcgccggagctcccgataggtgtcctccaacctgcctgtttatcgccggcattgcagaattaggtgccttcttttcaatcctgcaagacatgcggaatacaataatggctagcaaaaccgtggggacgagtgaggaaaagctccgaaagaaatcttccttctaccagagctaccttcgcagaactcagtcgatgggcattcagctggatcaaaggatcatcgtcttgtttatggtggcgtggggaaaggaggcagtggacaacttccacctaggcgatgacatggaccccgagctgcggacactcgcccagtctctgattgatgtcaaagttaaggaaatctccaatcaggagcctcttaaactgtga

SEQ ID NO: 5727 - RNA, 1290 nt, synthetic construct
  misc_feature 1..1290: note = derived and/or modified CDS sequence (opt3) from HTNV(GAN13/2011)__KY807168.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtgatctacctcaccagtttcgtcgtgcccatactgctgaaggccctctatatgttaactacacggggtcgccagaccactaaagacaataaggggacaagaatcaggtttaaagatgacagctccttcgaagacgttaacggcattcggaagcctaagcatctgtacctttctttgccaaatgctcaatcgtcaatgaaagccgaggaaatcacccccggacgctatcgaacggcgatttgcggcctgtaccctgcacagatcaaggccagacagatgataagcccagtgatgagtgtcattgggtttctagctctcgccaaagattggtccgacaggatcgagcagtggctgtctgaaccctgtaaacttctgcctgatactgcagctgtgagcttgcacggaggtccagccaccaaccgggactatctccgtcaacgccaggtagcgctgggcaatatggagacaaaggagtccaaggccattagacagcatgcagaaactgctgggtgctcaatgatcgatgacatcgagagtccgagctctatttgggttttcgccggagctcccgataggtgtcctccaacctgcttatttatagccggcatcgcagaactgggtgccttcttttccattctccaagacatgcggaacacaatcatggcttcaaaaaccgtggggacgagcgaggaaaaacttcgaaagaagagttctttctaccagtcctacctgcgcagaactcagagcatgggaatacagttggatcaaaggattatcgtcctatttatggtggcgtggggcaaggaggcagtggacaatttccacctgggcgatgacatggaccccgagctccggacactggcccagtcgcttatcgatgtcaaagttaaggaaatttctaaccaggagcctctgaaattgtga

SEQ ID NO: 5728 - RNA, 1290 nt, synthetic construct
  misc_feature 1..1290: note = derived and/or modified CDS sequence (opt3) from HTNV(GAN19/2011)__KY807172.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacagatcgagagggggttgctgccagcatacaggcaaagatcgacgaattgaaacgtcaattagccgatagaattgctactggaaagaacctgggtaaggagcaggaccctacgggcgtggaaccaggggatcatctaaaagagaggtccatgctctcttatggaaatgtactggaccttaaccacctggatatcgacgagccgaccggccagacagcagattggttgtcaattgtgatctacctcaccagtttcgtcgtgcccatactgctgaaggccctctatatgttaactacacggggtcgccagaccactaaagacaataaggggacaagaatcaggtttaaagatgacagctccttcgaagacgttaacggcattcggaagcctaagcatctgtacctttctttgccaaatgctcaatcgtcaatgaaagccgaggaaatcacccccggacgctatcgaacggcgatttgcggcctgtaccctgcacagatcaaggccagacagatgactagcccagtgatgagtgtcatagggtttctagctctcgccaaagattggtccgacaggattgagcagtggctgtctgaaccctgtaaacttctgcctgataccgcagctgtgagcttgcacggaggtccagccacatcccgggactatctccgtcaacgccaggtagcgctgggcaacatggagactaaggagtcaaaggccatcagacagcatgcagaaaccgctgggtgcagtatgattgatgacatcgagagcccgtcttccatctgggttttcgccggagctcccgataggtgtcctccaacatgcttatttattgccggcatagcagaactgggtgccttcttttcaatcctccaagacatgcggaataccattatggctagcaaaacggtggggacaagtgaggaaaaacttcgaaagaagtcttccctgtaccagagctacttgcgcagaactcagtcgatgggaatccagctagatcaaaggataattgtcctgttcatggtggcgtggggcaaggaggcagtggacaactttcacctcggcgatgacatggaccccgagctgcggacccttgcccagtctctgatcgatgtcaaagttaaggaaatctccaatcaggagcctttgaaactctga

SEQ ID NO: 5729 - RNA, 1290 nt, synthetic construct
  misc_feature 1..1290: note = derived and/or modified CDS sequence (opt3) from HTNV(LR1)__AF288294.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcgcgctgacaaaccgagagggggttgctgtgagcatacaggccaagatcgatgaattgaaaatgcaattagcagaccgtattgccactggaaagaatctgggtaaggagcaggatcctacgggcgtagaaccaggggaccatctaaaagagagatccatgctctcttatggaaacgtgctggatcttaatcacctggacatcgatgagccgaccggccagacagctgactggttgtcaattatcgtctacctcaccagtttcgtggttcccatactgctgaaggcactctatatgttaactacaaggggtcggcagaccactaaagataacaaggggacacgcatcagatttaaagacgatagctccttcgaagacgtgaatggaattaggaagcctaagcatctgtacgtctctcttccagacgcccaatcgtcaatgaaagctgaggaaatcacccccggccggtatcgcacggccgtgtgcggcttgtaccctgcgcagattaaggcacgacagatgatcagcccagtaatgagtgttatagggtttctggccctagctaaagattggtccgacagaattgagcagtggctcatcgaaccctgtaagctgcttcctgatactgccgcagtgtctctgttgggaggtccagctaccaacagggactatctccggcaacgtcaggtcgccctgggcaatatggagacaaaagagagcaaggcgattcgccagcacgccgaagcagctgggtgctccatgatcgaggatatcgaatcaccgagtagcatttgggtgttcgccggagctcccgacagatgtcctccaacttgcttatttatagccggcatcgcagagctgggtgccttcttttctattctccaagatatgaggaacaccatcatggcttccaaaacagtggggacctcagaagagaagctgcggaagaaaagcagtttctaccagtcttaccttcgacgcacgcagtccatgggaatacagttggaccaaagaattatcgtcctatttatggttgcgtggggcaaggaggcagtggataatttccatctgggcgacgatatggaccccgaactcaggactctggcccagagccttatcgacgtaaaagtgaaggagatttcgaaccaggaacctctgaaattgtga

SEQ ID NO: 5730 - RNA, 1290 nt, synthetic construct
  misc_feature 1..1290: note = derived and/or modified CDS sequence (opt3) from HTNV(RG9)__AF288296.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctgtacgtgtctcttccaaatgcccaatcgtcaatgaaagctgaggaaatcacgcccggacgctatcgaactgccatttgcggcttgtaccctgcgcagatcaaggcaagacagatgataagcccagtcatgagtgtgattgggtttctggccctagctaaagattggtccgacaggatcgagcagtggctctctgaaccctgtaagctgcttcctgataccgccgcagtaagcctgcacggaggtccagctacaaaccgggactatttgcgtcaacgccaggttgccctcggcaatatggagactaaagagtccaaggcgattagacagcatgccgaatcagcagggtgcagtatgatcgaggatatcgaaagcccgtcttccatttgggtgttcgctggagcccccgacaggtgtcctccaacctgcctgtttatagctggcatcgccgagttaggtgcattcttttcaattctgcaagatatgcggaacacaatcaccgccagcaaaacggtcgggacaagtgaagagaagctccgaaagaaatcttccttctaccagagctaccttcgcagaactcagtcgatgggaatacagctggaccaaaggattatcgtgttgtttatggtggcttggggcaaggaggcggtcgataatttccacctaggcgacgatatggaccccgaactgcggaccctcgcacagtctctgatcgacgttaaagtgaaggagatttccaaccaggaacctcttaaactgtga

SEQ ID NO: 5731 - RNA, 1290 nt, synthetic construct
  misc_feature 1..1290: note = derived and/or modified CDS sequence (opt3) from HTNV(S85-46)__AF288659.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaaagcgcgctgacaaaccgcgagggggttgctgtgtccatacaggccaagatcgatgaattgaaaatgcaattagcagaccgaattgccactggaaagaatctgggtaaggagcaggatcctacgggcgtagaaccaggggaccatctaaaagagcgttctatgctctcatatggaaacgtgctggatcttaatcacctggacatcgatgagccgaccggccagacagctgactggttgagtattatcgtctacctcactagcttcgtggttcccatactgctgaaggcactctatatgttaaccacaagaggtaggcagaccactaaagataacaaggggacacggatccgctttaaagacgattcctctttcgaagacgtgaatggaattagaaagcctaagcatctgtacgtctcgcttccaaacgcccaatcaagcatgaaagctgaggaaatcacccccggcaggtatcggacggccgtgtgcggcttgtaccctgcgcagattaaggcacgccagatgatcagtccagtaatgtccgttatagggtttctggccctagctaaagactggtctgatcgaattgagcagtggctcatcgaaccctgtaagctgcttcctgacactgccgcagtgagcctgttgggaggtccagctaccaatagagattatctcaggcaacggcaggtcgccctgggcaacatggagacaaaagagtccaaggcgattcgtcagcacgccgaagcagctgggtgctcaatgatcgaggacatcgaaagtccgagctctatttgggtgttcgccggagctcccggccgctgtcctccaacttgcttatttatagccggtatcgcagagctgggggccttcttttccattctccaagatatgagaaataccatcatggcttcaaaaacagtgggaaccagcgaagagaaacttaggaagaagagttctttctaccagtcctacctgcggcgaacgcagagcatgggcatacagttggaccaacgcattatcgtcctatttatggttgcgtggggcaaggaggcagtggataacttccatctgggggacgatatggaccccgaactcagaactctggcccagtcgcttatcgatgtaaaagtgaaggagatttctaatcaggaacctctgaaattgtga

SEQ ID NO: 5732 - RNA, 1290 nt, synthetic construct
  misc_feature 1..1290: note = derived and/or modified CDS sequence (opt3) from HTNV(SN7)__AF288657.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctgtacgtgtctcttccaaatgcccaatcgtcaatgaaaacggaggaaatcactcccggacgctatcgaaccgctatttgcggcttgtaccctgcccagatcaaggcgagacagatgataagcccagtcatgagtgtgattgggtttctggcactagccaaagattggtccgacaggatcgagcagtggctctctgaaccctgtaagctgcttcctgatacagctgccgtaagcctgcacggaggtccagcaactaaccgggactatttgcgtcaacgccaggttgctctcggcaatatggagaccaaagagtccaaggccattagacagcatgcggaatcagccgggtgcagtatgatcgaggatatcgaaagcccgtcttccatttgggtgttcgcaggagctcccgacaggtgtcctccaacatgcctgtttatagccggcatcgctgagttaggtgccttcttttcaattctgcaagatatgcggaacaccatcatggcaagcaaaacggtcgggacaagtgaagagaagctccgaaagaaatcttccttctaccagagctaccttcgcagaactcagtcgatgggaatacagctggaccaaaggattatcgtgttgtttatggtggcctggggcaaggaggctgtcgataatttccacctaggcgacgatatggaccccgaactgcggaccctcgcgcagtctctgatcgacgttaaagtgaaggagatttccaaccaggaacctcttaaactgtga

SEQ ID NO: 5733 - RNA, 1290 nt, synthetic construct
  misc_feature 1..1290: note = derived and/or modified CDS sequence (opt3) from HTNV(84FLi)__AF366568.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggctagcatacaggccaagatcgacgaattgaaacgtcaattagcagatagaattgccacgggaaagaacctgggtaaggagcaggaccctaccggcgtggaaccaggggatcatctaaaagagaggtccatgctctcttatggaaatgtactggaccttaaccacctggatatcgacgagccgacaggccagactgctgattggttgtcaattgtgatctacctcaccagtttcgtcgtgcccatactgctgaaggcactctatatgttaacaacccggggtcgccagactacaaaagacaataaggggaccagaatcaggtttaaagatgacagctccttcgaagacgttaacggcattcggaagcctaagcatctgtacgtgtctcttccaaatgcccaatcgtcaatgaaagctgaggaaatcacgcccggacgctatcgaactgccatttgcggcttgtaccctgcgcagatcaaggcaagacagatgataagcccagtcatgagtgtgattgggtttctggccctagctaaagattggtccgacaggatcgagcagtggctctctgaaccctgtaagctgcttcctgataccgccgcagtaagcctgcacggaggtccagctacaaaccgggactatttgcgtcaacgccaggttgccctcggcaatatggagactaaagagtccaaggcgattagacagcatgccgaatcagcagggtgcagtatgatcgaggatatcgaaagcccgtcttccatttgggtgttcgctggagcccccaacaggtgtcctccaacctgcctgtttatagctggcatcgccgagttaggtgcattcttttcaattctgcaagacatgcggaatacaatcatggccagcaaaaccgtcgggacgagtgaagagaagctccgaaagaaatcttccttctaccagagctaccttcgcagaactcagtcgatgggaatacagctggatcaaaggattatcgtgttgtttatggtggcttggggcaaggaggcggtcgacaacttccacctaggcgatgacatggatcccgaactgcggacactcgcacagtctctgatcgacgttaaagtgaaggagatttccaatcaggaacctcttaaactgtga

SEQ ID NO: 5734 - RNA, 1290 nt, synthetic construct
  misc_feature 1..1290: note = derived and/or modified CDS sequence (opt3) from HTNV(KHF,clone:4)__LC209206.1__N
  source 1..1290: mol_type = other RNA
atggccaccatggaggaactgcagagagagatcaacgctcacgaaggccaactcgtgattgcaaggcagaaggtccgggacgccgagaaacagtacgaaaaggatcccgacgagcttaataaacgcacactgactgatcgagagggggttgcggtgagcatacaggctaagatcgacgaattgaaacgtcaattagccgatagaattgcaacgggaaagaacctgggtaaggagcaggaccctaccggcgtagaaccaggggatcatctaaaagagaggtccatgctctcttatggaaatgtgctggaccttaaccacctggatatcgacgagccgacaggccagactgccgattggttgtcaattgtcgtgtacctcaccagtttcgttgtgcccatcctgctgaaggctctctatatgttaacaacccggggtcgccagactacaaaagacaataaggggaccagaataaggtttaaagatgacagctccttcgaagacgtcaacggaatccggaagcctaagcatctgtacgtgtctcttccaaatgcacaatcgtcaatgaaagccgaggaaattacgcccggccgctatcgaactgctgtatgcggcttgtaccctgcccagatcaaggcgagacagatgattagcccagttatgagtgtgatcgggtttctggcactagccaaagattggtccgacaggatagagcagtggctctctgaaccctgtaagctgcttcctgataccgctgccgtcagcctgttgggaggtccagcaacaaaccgggactatctccgtcaacgccaggtggctctgggcaatatggagactaaagagtccaaggccattagacagcacgcggaagccgcagggtgctcaatgatcgaggatattgaaagtccgagctctatctgggtgttcgctggagcccccgacaggtgtcctccaacctgcttatttatcgctggcattgccgagctgggtgcattcttttccatactccaagatatgcggaacacaatcatggcctcaaaaaccgtcgggacgagcgaagagaaacttcgaaagaagagttctttctaccagtcctacctgcgcagaactcagagcatgggcattcagttggaccaaaggatcatagttctatttatggtggcttggggaaaggaggcggtagataatttccatctgggcgacgatatggaccccgaactccggacactggcacagtcgcttattgacgtgaaagtcaaggagatctctaaccaggaacctctgaaattgtga

SEQ ID NO: 5735 - RNA, 1287 nt, synthetic construct
  misc_feature 1..1287: note = derived and/or modified CDS sequence (opt3) from LANV(510B)__AF005727.1__N
  source 1..1287: mol_type = other RNA
atgagcaacctgcaggaggtgcaagaaggcatcaccctccacgagcagcagcttgtcgccgctagacagaagctgaaggacgcagaaaaggccgttgaggtggatcccgacgatgtaaataaatccacattgcaatctaggcgggcggctgtgtcagccttagaaaacaagctggcagagctaaaacgccagctcgccgacctggtcgctgcacagaaacttgccgctaagcctgtggatccaactgggctggagccggacgatcatttgaaggaaaagagtgccctccgatacggaaatgttctggacgtgaacgcgattgatctggaggaacccagcggtcagacggcagactggaaagccataggcgcttatatcctcgggttcgtcattcctatcattttaaaggccctgtacatgctttccacccgtggaagacaaacagtgaaagagaataagggcactaggatccggtttaaggatgactcttcgttcgaggaagtaaacggtatacgcaaaccaaagcacttgtatgtttcaatgcccaccgcacagagcacaatgaaagctgatgagatcacccctgggagatttaggactattgcctgcggactgttcccagcgcagatcaaggcccggaatattatcagtcccgtgatgggcgtcataggctttgggcatttcgtgaaagactggatggaacgcattgacaactttctaggagaggattgtcctttcctcccaaaggcacgagtgcagtccgaggcttttatgtctacaaatagagcctacttcctgaacaggcaacggcaggtcgacgaaagccgtatccaggatattgttgaccttatccaagctgccgaggcatcctcagccaccctgtttaatgatatcgctacgccgcacagtgcgtgggtgttcgcatgcgcccccgaccgctgtcctccaactgctttgtatgtagccggtgtgcccgaactcggcgcatttttcgccattctgcaggatatgagaaacaccataatggctagcaaatctgtcgggacagccgaggaaaagttaaagaaaaagtccgcattctaccagtcatatctgaggcggactcagagcatgggaatccaactcgaccagaaaattatcatactttacatgctgagttggggcaaggaggcggtgaatcattttcacttgggtgatgacatggatcctgaactacgacagctggctcagaccctcattgacgccaaagttaaggagatctctaaccaagagccactgaaactttga

SEQ ID NO: 5736 - RNA, 1287 nt, synthetic construct
  misc_feature 1..1287: note = derived and/or modified CDS sequence (opt3) from LANV(12234)__ALD61435.1__N
  source 1..1287: mol_type = other RNA
atgagcaccctgcaggaggtgcaagaaggcatcacactccacgagcagcagcttgtcgccgctagacagaagctgaaagacgcagaaaaggccgttgaggtggatcccgacgatgtaaacaaatccactttgcaatctaggcgggcggctgtgtcagccttagaaaataagctggcagagctaaaacgccagctcgccgacctggtcgctgcacagaaacttgccgctaagcctgtggatccaacggggctggagccggacgatcatttgaaggaaaagagtgccctccgatacggaaacgttctggacgtgaatgcgattgatctggaggaacccagcggtcagaccgcagactggaaagccataggcgcttatatcctcgggttcgtcattcctatcattttaaaggccctgtacatgctttccacacgtggaagacaaactgtgaaagagaacaagggcaccaggatccggtttaaggatgactcttcgttcgaggaagtaaatggtatacgcaaaccaaagcagttgtatgtttcaatgcccacagcacagagcaccatgaaagctgatgagatcactcctgggagatttaggacaattgcctgcggactgttcccagcgcagatcaaggcccggaacattatcagtcccgtgatgggcgtcataggcttttcccacttcgtgaaagactggatggaacgcattgacgattttctagcagctgactgtcctttcctcccaaagccgcgagtgcaatctgaggcctttatggctaccaatagagcctacttcatcaacaggcagcggcagattgatgaaagccgtatgcccgacatcatggatctgatccaagcagccgaggctgggtccgcgacgctttttaatgacattgcaactcctcattcagcctgggtcttcgcttgcgccccagatcgctgtccccctaccgcactgtatgttgccggagtgccagagttgggtgcctttttcgctatactccaggacatgagaaacacaatcatggcaagtaaaagcgtaggcactgcggaagagaagctgaagaaaaagtctgctttctaccagtcctatttaaggcggacccagtcaatggggattcaactggatcagaaaatcataattctctacatgcttagctggggaaaggaagccgtgaatcactttcatctgggcgacgatatggaccccgagttgcgacagctagcacagacactgatcgacaccaaagtcaaggaaatcagtaaccaagagccgctcaagctgtga

SEQ ID NO: 5737 - RNA, 1272 nt, synthetic construct
  misc_feature 1..1272: note = derived and/or modified CDS sequence (opt3) from LQUV(Longquan-Rs-32)__JX465422.1__N
  source 1..1272: mol_type = other RNA
atggccaccggcagagacctgcaggatgagctcgaacaaatcgagcaggaaattacacaggctaaggcaaaatacgagaagcagaaagccgcgataggggaggaacccgacactatcgagcttaaggtgctgcaacagagggaagagacgattcacatgttggaagagaaacggaaggagttactgcagcgcatcgctcagcaaatgaaaagccctcgacagccagtcaaaggacgtgatctagacgaagatgagcatctctccgaaagatctaccctgaggtatggtaacgttattgaccttgaggaactggatatcgacgagccggccggcgggtcagcagattggttggccataggaatctacattttcagttttcccgtgcagctcctgctgaagacactctatatcttaactacccggggccgccagacaattaaagagaataagggtaacagactgaggttcaaagacagctcctctaccatggatgtaaatggggtgaagactcctcggcacctttacatctcgttgccaacagctcaatcaagcatgaagaccgaagagataacgcccggacgctatcgaactgtcgcatgcggcattctgagtggcgaaatgagagccaggaaactcgtgtcccctgttatgggggtgatcggatttaactacctcgctgagaagtggggtgaatatattgacgccttcctgatgaaacagtctccacatcttcccgtcagcaccggctcccctgagtcagcgacaaattttgcatacctgatccagcggcaagatgtgttgaacaagagtaaaactgtagagtacctcgaactgtgggagcaggccgaaaaggctgggcgtcacttagttgaccgcatcgagagcccactgaccccgtggctattcgccggatctcccgacagatgtcctccaacatccctttatgtggcaggcattgctgaactgggtgcctttttctcaatattgcaggatatcaggaatgcgattatggccagcaagctagtcgggaccgcagaggagaagctgaagcggaaaagttctttttaccagtcctatctccgacgcacgcaaagcatgggagtgcagctggaccagagaatcataattctttacatgatggaatggggcaagatgatggtggatcatttccacctgggcgacgatatggactcggagttgaggaaggcttgccagtctctcatcgatgaaaaagtcgcccaagtttccaaccaggaggctctgaaattatga

SEQ ID NO: 5738 - RNA, 1272 nt, synthetic construct
  misc_feature 1..1272: note = derived and/or modified CDS sequence (opt3) from LQUV(Longquan-Ra-14)__JX465414.1__N
  source 1..1272: mol_type = other RNA
atggccaccggcagagacctgcaggatgagctcgaacaaatcgagcaggaaattacacaggctaaggcaaaatacgagaagcagaaagccgcgataggggaggaacacgacactatcgagcttaaggtgctgcaacagagggaagagacgattcatatgttggaagagaaacggaaggagttactgcagcgcatcgctcagcaaatgaaaagcccccgacagcctgtcaaaggacgtgatctagacgaagatgagcacctctccgaaagatctaccctgaggtatggtaacgttattgaccttgaggaactggatatcgacgagccagccggcgggtcagcagattggttggccataggaatctacattttcagttttccggtgcagctcctgctgaagacactctatatcttaactacccggggccgccagacaattaaagagaataagggtaacagactgaggttcaaagacagctcctctaccatggatgtaaatggggtgaagactccccggcatctttacatctcgttgcctacagctcaatcaagcatgaagaccgaagagataacgccaggacgctatcgaactgtcgcatgcggcattctgagtggcgaaatgagagccaggaaactcgtgtcccccgttatgggggtgatcggatttaactacctcgctgagaagtggggtgaatatattgacgccttcctgatgaaacagtctcctcaccttccagtcagcaccggctcccccgagtcagcgacaaattttgcatacctgatccagcggcaagatgtgttgaacaagagtaaaactgtagagtacctcgaactgtgggagcaggccgaaaaggctgggcgtcatttagttgaccgcatcgagagccctctgaccccatggctattcgccggatctccggacagatgtccccctacatccctttatgtggcaggcattgctgaactgggtgcctttttctcaatattgcaggatatcaggaatgcgattatggccagcaagctagtcgggaccgcagaggagaagctgaagcggaaaagttctttttaccagtcctatctccgacgcacgcaaagcatgggagtgcagctggaccagagaatcataattctttacatgatggaatggggcaagatgatggtggatcacttccacctgggcgacgatatggactcggagttgaggaaggcttgccagtctctcatcgatgaaaaagtcgcccaagtttccaaccaggaggctctgaaattatga

SEQ ID NO: 5739 - RNA, 1272 nt, synthetic construct
  misc_feature 1..1272: note = derived and/or modified CDS sequence (opt3) from LQUV(Longquan-Ra-25)__JX465415.1__N
  source 1..1272: mol_type = other RNA
atggccaccggcagagacctgcaggatgagctcgaacaaatcgagcaggaaattacacaggctaaggcaaaatacgagaagcagaaagccgcgataggggaggaacccgacactatcgagcttaaggtgctgcaacagagggaagagacgattcacatgttggaagagaaacggaaggagttactgcagcgcatcgctcagcaaatgaaaagccctaagcagccagtcaagggacgagatctagacgaagatgagcatctctccgaacgttctaccctgagatatggtaacgttattgaccttgaggaactggatatcgacgagccggccggcgggtcagcagattggttggccataggaatctacattttcagttttcccgtgcagctcctgctgaaaacactctatatcttaactaccaggggccggcagacaattaaggagaataaaggtaaccgcctgagattcaaggacagctcctctaccatggatgtaaatggggtgaagactcctaggcacctttacatctcgttgccaacagctcaatcaagcatgaaaaccgaagagataacgcccggacggtatcgcactgtcgcatgcggcattctgagtggcgaaatgcgagccagaaagctagtgtcccctgttatgggggtgatcggatttaactacctcgctgagaaatggggtgaatatattgacgccttcctgatgaagcagtctccacatcttcccgtcagcaccggctcccctgagtcagcgacaaattttgcatacctgatccagaggcaagatgtgttgaacaaaagtaagactgtagagtacctcgaactgtgggagcaggccgaaaaagctgggcggcacttagttgaccgtatcgagagcccactgaccccgtggcttttcgccggatctcccgaccgctgtcctccaacatccctctatgtggcaggcattgctgaactgggtgcctttttctcaatattgcaggatatcagaaatgcgattatggccagcaagctagtcgggaccgcagaggagaagctgaaaaggaagagttctttttaccagtcctatctccggcgaacgcaaagcatgggaatccagctggaccagcgcataattatcctttacatgatggaatggggcaaaatgatggtggatcatttccacctgggcgacgatatggactcggagttgagaaaggcttgccagtctctcatcgatgaaaaagtggcccaagtctccaaccaggaggctctgaagttatga

SEQ ID NO: 5740 - RNA, 1287 nt, synthetic construct
  misc_feature 1..1287: note = derived and/or modified CDS sequence (opt3) from NYV(RI-1)__U09488.1__N
  source 1..1287: mol_type = other RNA
atgagcaccctgaaggaggtgcaggacaacatcacactccacgaacaacagcttgtcactgccagacagaaactgaaggatgctgagaaagcagttgaagtggaccccgatgacgtaaataagtccacgttgcagggcaggcgggccgcggtgtctgctttagagaccaaactgggggaactaaagcgccaactcgccgatctgattgcagcccagaaacttgcttcaaagcctatagacccaacaggaatcgagccggatgaccatctgaaggagaaaagtagcttgcgatacggtaacgtcctcgatgttaattccattgacctggaagaaccctctggccagactgcagattggaaggccatcgggatgtatattctgtcgttcgctatccctataatcctcaaagccttatacatgctgtcaacccgtggaagacagacagtgaaggaaaacaagggcaccaggattcggtttaaagacgatagcagttatgaggaggtgaatggtatccgcaagccaagacacctttacgtctccatgcccactgcgcaatctacaatgaaagcagacgaaattacccctgggaggttccggacgatcgcctgcggattgtttccagctcaggtgaaggcccgcaacataattagccccgtaatgggcgttatcggcttcaactttttcgtgaaagactggatggatcgaattgacgattttctggcagagagatgtcctttcctaccagaaccgagggaccccaaggatgctgccctcgggactaatcgggcgtattttatcacccgtcaggcccaggtcgacgagtccaaagtggtggatatcgaggagctgattgtcgacgcacgcgctgagtcagccacacttttcgctgatatagccactcctcatagtgtttgggtgtttgcatgcgccccagacagatgtccccctaccgctctgtacgtagcgggaatgccagaattgggtgcattctttgccatcctccaagatatgaggaatacaattatggctagcaagtctgtgggcaccgccgaggaaaagctgaaaaagaaatccgcattctatcagtcatacttacggcgaacgcagagcatggggatccaactggaccagaagataattatcctctacatgatccactggggaaaagaggccgtcaaccatttccaccttggcgacgatatggaccccgaactgcgcgagttggctcaggccctagtggatgcaaaggttaaggagattagtaatcaggaaccgctgaaactctga

SEQ ID NO: 5741 - RNA, 1302 nt, synthetic construct
  misc_feature 1..1302: note = derived and/or modified CDS sequence (opt3) from PUUV(K27)__L08804.1__N
  source 1..1302: mol_type = other RNA
atgagcgacctgaccgatatccaggaggaaattacaagacacgagcaacagctcgtggtcgccaggcagaaacttaaagacgctgaacgggcagttgaggtgtaccccgatgacgtaataaagaacactctgcaggcccgccaacagacggtgtccgcgttggaagataaattagctgactataagcgacgtatggccgatgcagtctctagaaagaagatggacaccaagcctacagatccaactggcatcgagccggacgatcatctgaaagagaggtcaagtctacggtacgggaatgtgctcgacgttaacgccattgatatcgaagaacccagcggacagaccgctgactggtatacaattggtgtgtacgtcatcggcttcaccatacctatcattctgaaggcactttatatgctgtccactcgcgggagacagacagtgaaagaaaataagggaaccaggatccggtttaaagacgatacgtctttcgaggacattaacggcatccgccgaccaaagcacttgtacgtatcgatgcccactgcccaatcaaccatgaaggctgaggaactcacacctggtagatttaggactatagtttgcgggctgttcccaacccagattcaggtgcggaatatcatgagccccgtcatgggagtgattggctttagtttctttgtgaaagattggcctgagaagatccgtgagttcatggagaaagaatgtccatttatcaagccggaggtcaaacccggcacccctgcccaggaggttgagttcctgaagcgcaacagagtgtattttatgacaaggcaagacgtactcgataaaaatcatgtggcggacattgataagttaatagactacgcagcctccggggatccaacgtctcccgacgatatcaagagccctaacgctccatgggtcttcgcctgcgcacccgaccggtccccgcctacttgtatttacgtggctggaatggccgaactgggtgcgtttttctcaatccttcaggacatgcgaaatacaataatggccagtaaaaccgttggcactgcagaagagaagttgaaacgcaagagctctttctatcagtcctacctgagaaggacacaatcaatggggattcagctagatcagcggatcatcctcctgtatatgcttgaatggggaaaagagatggtggaccactttcatctgggcgatgacatggatcccgagttgcgcggtctcgctcagagcctgattgaccaaaaggtcaaggaaatcagtaaccaggagccattaaaaatttga

SEQ ID NO: 5742 - RNA, 1302 nt, synthetic construct
  misc_feature 1..1302: note = derived and/or modified CDS sequence (opt3) from PUUV(KS13/855)__KX815394.1__N
  source 1..1302: mol_type = other RNA
atgagcgacctgaccgatatccaggaggacattacaagacacgaacaacagctcgtggtcgccaggcagaagttaaaagatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatgcgggctgtttccaacccagatccaggttaggaacataatgagccccgtgatgggagtcattggcttctcctttttcgtgaaggattgggccgaacggatccgtgagtttatggaaaaagagtgtcctttcattaagccagaagtgaaaccgggcacacccgcgcaggaggtcgagtttctcaagaaaaataaggtttatttcatgcaacgccaggacgtgttagataagaaccatgtagcagacatcgataaactgatcgactacgccgctagtggggatcctacctctccagacaatattgaaagccccaacgccccttgggtgtttgcatgcgctccagacagatgtcccccgacgtgcatatatgtcgccggaatggcggagcttggtgccttcttctccatcttgcaggatatgaggaatactattatggcatcaaagacagtgggcaccgctgaagagaaactgaagaaaaagagtagcttttaccaatcttacctacggcgaactcagtccatggggatccagctcgaccagcgcataattctgctttatatgctggaatggggaaaggagatggttgatcacttccatttgggcgacgatatggaccctgagctcagaggtctggcccaagctcttatcgatcagaaagtgaaggaaatctcaaaccaggagcccctgaaaatttga

SEQ ID NO: 5743 - RNA, 1302 nt, synthetic construct
  misc_feature 1..1302: note = derived and/or modified CDS sequence (opt3) from PUUV(KS14/118)__KX815395.1__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgacttcaagcgacgtatggccgatgcagtctctagaaagaagatggacaccaagcctacagatccaactggcatagaaccggacgatcatctgaaagagaggtcaagtctacggtacgggaacgtgctcgacgttaatgccatcgacattgaggaacccagcggacagaccgctgattggtatacaatcggtgtgtacgtcattggctttaccatccctataatcctgaaggcactttatatgctgtccactcgcgggagacagacagtgaaagagaacaagggaaccaggattcggttcaaagacgatacgtcttttgaagacatcaatggcattcgccgaccaaagcacttgtacgtatcgatgcccactgcccaatcaaccatgaaggctgaggagctcacacctggtagattcaggactatcgtttgcgggctgtttccaacccagatacaggtgcggaacattatgagccccgtcatgggagtgatcggcttctcctttttcgtgaaaaattggcctgaacgtattaaggagtttatggaaaaagagtgtccattcatcaagccggaagtcaaacccggcacccctgcccaggaggttgagtttctgaagcgcaacaaagtgtatttcatgaatagacaagatgtactcgacaagaaccatgtggcggatatcgacaagttaattgattacgcagccagtggggacccaacatctcccgatgacatagaaagccctaatgctccatgggtctttgcctgcgcacccgacaggtgtccgcctacgtgcatctatgtggctggaatggccgagctgggtgcgttcttctccattcttcaggatatgcggaacactatcatggcctcaaaaacagttggcaccgcagaagagaagttgaaaaagaaaagtagcttttaccagtcttacctgcgacgcactcaatccatggggatacagctagaccagagaattatcctcctgtatatgcttgaatggggaaaggagatggtggatcacttccatctgggcgacgatatggaccccgagttgaggggtctcgctcaggccctgatcgatcaaaaggtcaaagaaatttcaaatcaggagccattaaagatctga

SEQ ID NO: 5744 - RNA, 1302 nt, synthetic construct
  misc_feature 1..1302: note = derived and/or modified CDS sequence (opt3) from PUUV(LT15/201)__KX757841.1__N
  source 1..1302: mol_type = other RNA
atgagcgacctgaccgatatccaggaggacattacaagacacgaacaacagctcgtggtcgccaggcagaagttaaaagatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctatagatccaacaggcatcgaaccggacgatcatctgaaggagagatcaagtctaaggtacgggaacgtcctcgacgtgaatgccattgacatcgaggaacccagcggacagactgctgattggtataccattggtgtttacgtgatcggctttacactgcctataatccttaaagcactgtatatgttgtccacccgggggcgccagactgtcaaggagaacaaaggaacaagaattaggttcaaggacgatacctcttttgaagacatcaatggcattcggcgcccaaagcacctctacgtgtcgatgcccacggcccaatcaactatgaaagctgaggagctgacccctggtcgattcagaacaatcgtatgcgggctgtttccaactcagatacaggttaggaacattatgagccccgtgatgggagtcatcggcttctcctttttcgtgaaggattgggccgaacggattcgtgagtttatggaaaaagagtgtcctttcatcaagccagaagtgaaaccgggcacccccgcgcaggaggtcgagtttctcaagaaaaataaggtttatttcatgcaacgccaggacgtgttagataagaaccatgtagcagacatcgataaactgattgactacgccgctagtggggatcctacatctccagacaatatagaaagccccaacgccccttgggtgtttgcatgcgctccagacagatgtcccccgacctgcatctatgtcgccggaatggcggagcttggtgccttcttctccattttgcaggatatgaggaatacgatcatggcatcaaagactgtgggcacagctgaagagaaactgaagaaaaagagtagcttttaccaatcttacctacggcgaacccagtccatggggatacagctcgaccagcgcattatcctgctttatatgctggaatggggaaaggagatggttgatcacttccatttgggcgacgatatggaccctgagctcagaggtctggcccaagctcttatcgatcagaaagtgaaggaaatttcaaaccaggagcccctgaaaatctga

SEQ ID NO: 5745 - RNA, 1302 nt, synthetic construct
  misc_feature 1..1302: note = derived and/or modified CDS sequence (opt3) from PUUV(PUU/Ernstbrunn/Cg641/1995)__AJ888752.1__N
  source 1..1302: mol_type = other RNA
atgagcgacctgaccgatatccaggaggacattacaagacacgaacaacagctcgtggtcgccaggcagaaacttaaagatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatcaagcggccaaaacacctctacgtgtcgatgcccactgcccaatcaaccatgaaggctgagaaactgacacctggtcgcttccgaactattgtatgcgggctgtttccaacccagatccaggttagaaacataatgagccccgtgatgggagtcattggcttcagctttttcgtgaaggattggtccgagagggtgcgggactttatggaaaaagagtgtcctttcatcaagccagaaattaaaccgggcacaccccctcaggaggccgaatttctcaagcgtaataaggtctatttcatgcaacgccaggatgttttagacaaaaaccatgtggcggatatcgacaagctgatcgattacgcagcctctggggacccaaccagccccgacaatcttgagtcccctaacgctccatgggtatttgcctgcgcacccgatagatgtccgcctacgtgcatttatgtggctggaatggccgagttgggtgcgttcttctcaatactgcaggacatgaggaatactatcatggccagtaaaacagtcggcaccgcagaagagaagctaaagaagaagagttctttttaccaatcctacctccggcgaactcagtcaatggggattcagctggatcagcgcatcatacttctgtatatgttggaatggggaaaagagatggtggaccacttccatctcggcgatgacatggatcccgaactgagaggtttagctcaagccctgattgaccagaaggttaaagagatcagcaaccaggagccactcaagatctga

SEQ ID NO: 5746 - RNA, 1302 nt, synthetic construct
  misc_feature 1..1302: note = derived and/or modified CDS sequence (opt3) from PUUV(PUU/Klippitztoerl/Cg9/1995)__AJ888751.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccggaggtcagaccgctgattggtatacaatcggcgtttacgtgattgggtttaccctgcctatcatacttaaagcactgtatatgttcagcactcggggacgccagacagtcaaggagaacaaaggcaccagaatcaggtttaaggacgatacgtccttcgaagacattaatggtatccggcgcccaaagcacttgtacgtgtctatgcccactgcccaatcgaccatgaaagctgaggagctcacacctgggcgatttagaactattgtatgcggactgttcccaacccagatccaggttaggaacataatgtcacccgtgatgggcgtcattggctttagcttctttgtgaaggattggagtgaacgggtgcgtgacttcatggagaaagaatgtccttttatcaagccagagattaaaccggggacaccccctcaggaagccgagttcctgaagcgcaataaagtctattttatgcaaagacaggatgttctcgacaagaaccatgtggcggatatcgacaagttaatcgattacgcagcctccggagacccaacctctcccgacaatctggagagccctaacgctccatgggtattcgcctgcgcacccgataggtgtccgcctacgtgcatttatgtggctggtatggccgaacttggcgcgttcttttccatattgcaggacatgcggaatactatcatggcctcaaaaacagtcgggaccgcagaggaaaagctgaaaaagaaaagtagcttctaccaatcttacctacgacgcactcagtccatgggcattcagctcgatcagagaatcatactgctttatatgctggagtggggaaaggaaatggtggaccactttcatttgggtgatgacatggatcccgagctcagggggctggctcaagccttaattgaccagaaggttaaagagatctcaaaccaggaaccactgaagatctga

SEQ ID NO: 5747 - RNA, 1302 nt, synthetic construct
  misc_feature 1..1302: note = derived and/or modified CDS sequence (opt3) from PUUV(Balkan-1)__AJ314600.1__N
  source 1..1302: mol_type = other RNA
atgagcgacctgaccgatatccaggaggacattacaagacacgaacaacagctcgtggtcgccaggcagaaacttaaagatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatgcgggctgtttccaacccagatccaggttaggaacataatgagccccgtgatgggagtcattggcttctcctttttcgtgaaggattggagtgaacgggtgcgtgagtttatggaaaaagagtgtcctttcatcaagccagaaattaaaccgggcacaccccctcaggaggccgagtttctcaagcgcaataaagtctatttcatgcaaagacaggacgttttagataagaaccatgtggcggacatcgataagctgcttgactacgcagcctctggggatccaaccagccacgacaatatcgaatcccccaacgctccttgggtatttgcctgcgcaccagacaggtgtcccccgacgtgcatttatgtggctggaatggccgagttgggtgcgttcttctcaatactgcaggatatgcggaatactatcatggccagtaaaacagtcggcaccgcagaagagaagctaaagaagaaaagctctttttaccaatcctacctccgacgcactcagtcaatggggattcagctggaccagagaatcatacttctgtatatgttggaatggggaaaggagatggtggatcatttccacctcggcgacgatatggaccctgagctgaggggtttagctcaagccctgattgatcagaaggttaaagaaatcagcaaccaggagcccctcaagatctga

SEQ ID NO: 5748 - RNA, 1302 nt, synthetic construct
  misc_feature 1..1302: note = derived and/or modified CDS sequence (opt3) from PUUV(Balkan-2)__AJ314601.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatttgggctgttcccaacccagatccaggttaggaacataatgagccccgtgatgggagtcattggctttagtttctttgtgaaggattggtccgaacgggtgcgtgagttcatggaaaaagagtgcccttttatcaagccagaaattaaaccgggcgctccccctcaggaggcggagttcctcaagcgcaataaagtctattttatgcaaagacaggacgttttagataagaaccatgtggcagacatcgataagctgatcgactacgccgcttctggggatccaacaagccccgacaatattgaatcccctaacgccccatgggtattcgcatgtgctcccgacaggtgcccgcctacctgtatatatgtggccggaatggcggagcttggtgccttcttttcaatcttgcaggatatgcggaatacgattatggcaagtaaaactgtcggcacagctgaagagaagctgaaaaagaaaagctctttctaccaatcctacctacgacgcacccagtcaatggggatccagctcgaccagagaataattctgctttatatgctggaatggggaaaggagatggtggatcactttcatttgggcgacgatatggaccccgagctcaggggtctggcccaagccttaatcgatcagaaggttaaagaaatcagcaaccaggagccactgaagatttga

SEQ ID NO: 5749 - RNA, 1302 nt, synthetic construct
  misc_feature 1..1302: note = derived and/or modified CDS sequence (opt3) from PUUV(Baltic/205Cg/00)__AJ314599.1__N
  source 1..1302: mol_type = other RNA
atgagcgacctggccgatatccaggaggacattaccagacacgaacaacagctcgtggtcgctaggcagaaacttaaagatgcagagcgggccgttgaagtggaccccgatgacgtaaacaagaatacactgcaggcgcgccaacagactgtgtccgctttggaggataaattagccgactacaagcgacgtatggcagatgccgtctctagaaagaagatggacacgaagcctaccgatccaacaggcatagaaccggacgatcatctgaaagagaggtcaagtctacggtatgggaacgtgctcgacgttaatgctatcgacattgaggaacccagcggacagactgcagattggtacaccatcggtgtgtatgtcattggcttcacactgcctatcatacttaaggccctgtacatgttgtccacccgcgggagacagactgtgaaagagaacaagggaacaaggatccggtttaaagacgatacctctttcgaagacattaatggcatccgccgaccaaagcacctctatgtatcgatgcccacggctcaatcaactatgaaggccgaggagctgacccctggtagatttaggacaattgtttgcgggctgttcccaactcagatccaggtgcggaacataatgagccccgtcatgggagtgattggctttagtttctttgtgaaagattggcctgaacgtatcaaggagttcatggaaaaagagtgtccatttattaagccggaagtcaaacccggcacccctacacaggaggttgagttcctcaagcgcaataaagtgtactttatgaacagacaagacgtattagataagaatcatgtggcggacatcgataagctgatcgactatgcagcctccggggatccaacctctcccgacgacattgaaagccctaacgctccatgggtcttcgcctgcgcacccgataggtgtccgcctacgtgcatatacgtggctggaatggccgagcttggtgcgtttttctccatcttgcaggacatgcggtcaactattatggccagtaaaacagttggcaccgcagaagagaagctgaaaaagaaaagctctttctaccagtcctatctacgacgcactcaatcaatggggatccagctcgatcagagaataattctgctttacatgctggaatggggaaaggagatggtggaccactttcatttgggcgatgacatggatcccgagctcaggggtctggctcaggccttaatcgaccaaaaggtcaaagaaatcagcaatcaggagccactgaagatttga

SEQ ID NO: 5750 - RNA, 1302 nt, synthetic construct
  misc_feature 1..1302: note = derived and/or modified CDS sequence (opt3) from PUUV(Baltic/49Cg/00)__AJ314598.1__N
  source 1..1302: mol_type = other RNA
atgagcgacctggccgatatccaggaggacattaccagacacgaacaacagctcgtggtcgctaggcagaaacttaaagatgcagagcgggccgttgaagtggaccccgatgacgtaaacaagaatacactgcaggcgcgccaacagactgtgtccgctttggaggataaattagccgactacaagcgacgtatggcagatgccgtctctagaaagaagatggacacgaagcctaccgatccaacaggcatagaaccggacgatcatctgaaagagaggtcaagtctacggtatgggaacgtgctcgacgttaatgctatcgacattgaggaacccagcggacagactgcagattggtacaccatcggtgtgtatgtcattggcttcacactgcctatcatacttaaggccctgtacatgttgtccacccgcgggagacagactgtgaaagagaacaagggaacaaggatccggtttaaagacgatacctctttcgaagacattaatggcatccgccgaccaaagcacctctatgtatcgatgcccacggctcaatcaactatgaaggccgaggagctgacccctggtagatttaggacaattgtttgcgggctgttcccaactcagatccaggtgcggaacataatgagccccgtcatgggagtgattggctttagtttctttgtgaaagattggcctgaacgtatcaaggagttcatggaaaaagagtgtccatttattaagccggaagtcaaacccggcacccctgcgcaggaggttgagttcctcaagcgcaataaagtgtactttatgaacagacaagacgtattagataagaatcatgtggcagacatcgataagctgatcgactatgccgcttccggggatccaacatctcccgacgacattgaaagccctaacgccccatgggtcttcgcatgcgctcccgataggtgtccgcctacctgcatatacgtggccggaatggcggagcttggtgcctttttctccatcttgcaggacatgcggaatacgattatggcatcaaaaactgttggcacagctgaagagaagctgaaaaagaaaagtagcttctaccagtcttatctacgacgcacccaatccatggggatccagctcgatcagagaataattctgctttacatgctggaatggggaaaggagatggtggaccactttcatttgggcgatgacatggatcccgagctcaggggtctggcccaggctttaatcgaccaaaaggtcaaagaaatctcaaaccaggagccactgaagatttga

SEQ ID NO: 5751 - RNA, 1302 nt, synthetic construct
  misc_feature 1..1302: note = derived and/or modified CDS sequence (opt3) from PUUV(Pallasjarvi/63Cg/98)__AJ314597.1__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgactacaagcgacgtatggccgatgcagtctctagaaagaagatggacaccaagcctacagatccaactggcatagaaccggacgatcatctgaaagagaggtcaagtctacggtatgggaacgtgctcgacgttaatgccatcgacattgaggaacccagcggacagaccgctgattggtacacaatcggtgtgtatgtcattggcttcaccctgcctatcatacttaaggcactgtacatgttgtccactcgcgggagacagacagtgaaagagaacaagggaaccaggatccggtttaaagacgatacgtctttcgaagacattaatggcatccgccgaccaaagcacctctatgtatcgatgcccactgcccaatcaaccatgaaggctgaggagctgacacctggtagatttaggactattgtttgcgggctgttcccaacccagatccaggtgcggaacataatgagccccgtcatgggagtgattggctttagtttctttgtgaaagattggtccgaacgtatccgcgagttcatggaaaaggagtgtccttttattaaaccagaagtcaagccgggcacacccgcccaggaggttgagatgctcaaaagaaataagatctacttcatgcaaaggcaggacgtgttagataaaaaccatgtagcggacatcgataagctgattgactatgcagcctctggggatcctaccagcccagacaatatagactcccccaacgctccttgggtgtttgcctgcgcaccagatcggtgtcccccgacgtgcatctacgtcgctggaatggccgaacttggtgcgttcttttcaattttgcaggacatgcgaaatactatcatggccagtaagacagtgggcaccgcagaggaaaaactgaagaaaaagagctctttctaccaatcctatctacgcagaactcagtcaatggggatacagctcgatcagaggattatcctgcttttcatgctggagtggggaaaagaaatggttgaccactttcatttgggcgatgacatggatcctgagctccggggtctggctcaagccttaatcgaccagaaggtgaaggagattagcaaccaggaacccctgaaaatctga

SEQ ID NO: 5752 - RNA, 1302 nt, synthetic construct
  misc_feature 1..1302: note = derived and/or modified CDS sequence (opt3) from PUUV(Sotkamo 2009)__HE801633.1__N
  source 1..1302: mol_type = other RNA
atgagcgacctgaccgatatccaggaggacattacaagacacgaacaacagctcatagtggccaggcagaaacttaaagatgctgagcgggcagtcgaagttgaccccgatgacgtgaacaagaatactctgcaggcccgccaacagacggtatccgcgttggaggataaattagctgactacaagcgacgtatggccgatgcagtgtctagaaagaagatggacaccaagcctacagatccaactggcatcgaaccggacgatcatctgaaagagaggtcaagtctacggtatgggaacgtcctcgacgtgaatgccattgacatcgaggaacccagcggacagaccgctgattggtacacaattggtgtttatgtgatcggcttcaccctgcctataatccttaaggcactgtacatgttgtccactcgcgggagacagacagtcaaagagaacaagggaaccaggattcggtttaaagacgatacgtctttcgaagacatcaatggcattcgccgaccaaagcacctctatgtgtcgatgcccactgcccaatcaaccatgaaggctgaggagctgacacctggtagatttaggactatcgtatgcgggctgttcccaacccagatacaggttcggaacattatgagccccgtgatgggagtcatcggctttagtttctttgtgaaagattggtccgaacgtattcgcgagttcatggaaaaggagtgtccttttatcaaaccagaagtgaagccgggcacacccgcccaggagatcgagatgctcaaaagaaataagatttacttcatgcaaaggcaggacgtcttagataaaaaccatgttgcggacatagataagctgatcgactatgcagcctctggggatcctaccagcccagacaatattgactcccccaacgctccttgggtgtttgcctgcgcaccagatcggtgtcccccgacgtgcatctacgtagctggaatggccgaacttggtgcgttcttttcaatattgcaggacatgcgaaatactattatggccagtaagacagtgggcaccgcagaggaaaaactgaagaaaaagagctctttctaccaatcctatctacgcagaactcagtcaatggggatccagctcgatcagaggatcattctgcttttcatgctggagtggggaaaagaaatggtcgaccactttcatttgggcgatgacatggatcctgagctccggggtctggctcaagccttaatcgaccagaaggtgaaggagattagcaaccaggaacccctgaaaatatga

SEQ ID NO: 5753 - RNA, 1302 nt, synthetic construct
  misc_feature 1..1302: note = derived and/or modified CDS sequence (opt3) from PUUV(CG 13891)__U22423.1__N
  source 1..1302: mol_type = other RNA
atgagcgacctgaccgatatccaggaggacattacaagacacgaacaacagctcgtggtcgccaggcagaaacttaaagatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggccaaagcacctctacgtgtcgatgcccactgcccagtcaaccatgaaagctgaggagctgacacctggtcgcttccgaactattgtatgcgggctgtttccaacccagatccaggttagaaacataatgagccccgtgatgggagtcattggcttcagtttcttcgtgaaggattgggccgacaggatccgggaatccatggagaaagaatgtccttttctcaagccagatgtgaaaccgggcacacccgcgcaagagaccgaatttttaaagcgtaataaaatttattttatgcagcgccaggaggtcctggacaagaaccatgttgcagagatcgataaacttatcgactacgccgcttctggggatcctacgagcccagacaatattgaatcccccaacgccccttgggtgttcgcatgcgctccagacagatgtcccccgacttgcatatatgtagccggaatggcggagttgggtgcctttttctcaatcctgcaagatatgaggaatacaattatggcaagtaagaccgtgggcactgctgaagagaagctaaagaagaaaagctctttctaccagtcctacctccggcgaacacagtcaatggggatccagctggaccaacgcataattcttctgtatatgttggaatggggaaaggagatggtcgatcactttcatctcggcgacgatatggaccctgagctgagaggtttagcccaggctctgatcgatcagaaggtgaaagaaatcagcaaccaggagcccctcaagatttga

SEQ ID NO: 5754 - RNA, 1302 nt, synthetic construct
  misc_feature 1..1302: note = derived and/or modified CDS sequence (opt3) from PUUV(CG1820)__M32750.1__N
  source 1..1302: mol_type = other RNA
atgagcgacctgaccgatatccaggaggaaattacaagacacgagcaacagctcgtggtcgccaggcagaaacttaaagacgctgaacgggcagttgaggtggatcccgacgatgtaaacaagtccactctgcaggcccgccaacagacggtgtctgcgttggaagacaaattagctgattacaagcgacgtatggccgacgcagtctcaagaaagaagatggataccaagcctacagacccaactggcatagagccggatgaccatctgaaagagaggagtagcctacggtatgggaatgtgctcgatgttaacgccatcgacattgaagaaccctccggacagaccgctgactggtacacaatcggtgtgtatgtcattggcttcaccatccctataatcctgaaggcactttacatgctgtctactcgcgggagacagacagtgaaagaaaataagggaaccaggattcggtttaaagatgacacgtcgttcgaggatatcaacggcattcgccgaccaaagcacttgtatgtatcaatgcccactgcccaaagcaccatgaaggctgaggaactcacacctggtagatttaggactatcgtttgcgggctgttcccaacccagatacaggtgcggaatattatgagtcccgtcatgggagtgatcggcttttccttctttgtgaaagactggcctgagaagattcgtgagttcatggagaaagaatgtccatttatcaagccggaggtcaaacccggcacccctgcccaggaggttgagttcctgaagcgcaacagagtgtactttatgacaaggcaagatgtactcgacaaaaatcatgtggcggatatcgacaagttaattgattatgcagcctctggggacccaacgagccccgatgacatagaatcccctaacgctccatgggtcttcgcctgcgcacccgaccggtgtccgcctacttgcatctacgtggctggaatggccgaactgggtgcgtttttctcaattcttcaggatatgcgaaatacaatcatggccagtaagaccgttggcactgcagaggaaaaattgaagaaaaagagctctttctaccagtcctatctgcgcagaacacaatcaatggggatacagctagaccagaggattatcctcctgtacatgcttgagtggggacgggagatggtggatcactttcatctgggcgacgatatggaccccgaattgcgcggtctcgctcagagcctgatcgatcaaaaagtcaaggagattagtaaccaggaaccattaaagatctga

SEQ ID NO: 5755 - RNA, 1302 nt, synthetic construct
  misc_feature 1..1302: note = derived and/or modified CDS sequence (opt3) from PUUV(Bussjo_95-1)__AM746297.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatgcgggctgtttccaacccagatccaggttaggaacataatgagccccgtgatgggagtcattggcttctcctttttcgtgaaggattggcctgaccggatccgtgaatttatggagaaagaatgtccattcattaagccggaggtgaaacccggcacacctacccaggaaatcgagtttctcaagaaaaataaggtctatttcatggatcgccaaaacgttttagacaagaatcatgtggccgatatcgacaaactgattgattacgcggcaagtggggacccaacgtctcccgacaacatagagagccctaatgccccatgggtatttgcttgcgcccccgatagatgtccgcctacttgcatctatgtggcaggaatggctgaacttggtgccttcttctccattttgcaggacatgaggaacacaatcatggcgtcaaagaccgtcggcactgccgaggaaaaactgaagaaaaagagtagcttttaccagtcttacctacggcgaacacaatccatggggatacagctcgatcagcgcattatcctgctttatatgctggagtggggaaaggaaatggtggaccacttccatttgggcgatgacatggatcccgagctcagaggtctggcacaggctttaatcgaccaaaaagttaaggagatttcaaatcaggatccactgaaaatctga

SEQ ID NO: 5756 - RNA, 1302 nt, synthetic construct
  misc_feature 1..1302: note = derived and/or modified CDS sequence (opt3) from PUUV(CG144)__AF367064.1__N
  source 1..1302: mol_type = other RNA
atgagcgacctgaccgatatccaggaggacattacaagacacgaacaacagctcgtggccgctaggcagaaacttaaagatgcagagcgggccgtcgaaatggaccccgatgacgttaacaagaatactctgcaggcgcgccaacagacggtgtccgctttggaggataaattagccgactacaagcgacgtatggcagatgccgtatctagaaagaagatggacaccaagcctgctgatccaacaggcatagaaccggacgatcatctgaaagagaggtcaagtctacggtatgggaacgtgctcgacgtcaatgcaatcgacattgaggaacccagcggacagactgccgattggtacaccatcggtatttatgtgatcggcttcacactgcctataatccttaaggctctgtacatgttgtccacccgcgggagacagactgttaaagagaacaagggaacaaggattcggtttaaagacgatacctctttcgaagacatcaatggcattcgccgaccaaagcacctctatgtgtcgatgcccacggcccaatcaactatgaaggcggaggagctgacccctggtagatttaggacaatcgtctgcgggctgttcccaactcagatacaggtgcggaacattatgagccccgtaatgggagttatcggctttagtttctttgtgaaagattggcctgaacgtattcgcgagttcatggaaaaggagtgtccatttatcaaaccggaagtcaagcccggcacccctgcacaggagatcgagatgctcaaaaagaataaaatttacttcatgcatagacaagacgtgttagataagaaccacgtggccgacatagataagctgatcgactatgctgcctccggggatccaacatctcccgacaatattgacagccctaacgcaccatgggtctttgcttgcgcccccgataggtgtccgcctacctgcatctacgttgcgggaatggccgaacttggtgcattcttttccatattgcaggacatgcggaatacgattatggcttcaaaaactgtgggcacagccgaggaaaagctgaaaaagaaaagtagcttctaccagtcttatctacgacgcacccaatccatggggatccagctcgatcagagaatcattctgctttacatgctggagtggggaaaggaaatggtagaccatttccacttgggcgatgacatggatcccgagctcaggggtctggctcaggccttaatcgaccaaaaggtgaaagagatttcaaaccaggaaccactgaagatatga

SEQ ID NO: 5757 - RNA, 1302 nt, synthetic construct
  misc_feature 1..1302: note = derived and/or modified CDS sequence (opt3) from PUUV(CG168)__AF367065.1__N
  source 1..1302: mol_type = other RNA
atgagcgacctgaccgatatccaggaggacattacaagacacgaacaacagctcgtggccgctaggcagaaacttaaagatgcagagcgggccgtcgaaatggaccccgatgacgttaacaagaatactctgcaggcgcgccaacagacggtgtccgctttggaggataaattagccgactacaagcgacgtatggcagatgccgtatctagaaagaagatggacaccaagcctgctgatccaacaggcatagaaccggacgatcatctgaaagagaggtcaagtctacggtatgggaacgtgctcgacgtcaatgcaatcgacattgaggaacccagcggacagactgccgattggtacaccatcggtgtgtatgttattggcttcacactgcctatcatacttaaggctctgtacatgttgtccacccgcgggagacagactgtgaaagagaacaagggaacaaggatccggtttaaagacgatacctctttcgaagacattaatggcatccgccgaccaaagcacctctatgtctcgatgcccacggcccaatcaactatgaaggcggaggagctgacccctggtagatttaggacaattgtgtgcgggctgttcccaactcagatccaggtacggaacataatgagccccgttatgggagtgattggctttagtttctttgtcaaagattggcctgaacgtatccgcgagttcatggaaaaggagtgtccatttattaaaccggaagtgaagcccggcatccctgcacaggagatcgagatgctcaaaaagaataaaatttacttcatgcatagacaagacgtgttagataagaaccacgtcgccgacatagataagctgatcgactatgctgcctccggggatccaacctctcccgacaatattgacagccctaacgcaccatgggtttttgcttgcgcccccgataggtgtccgcctacatgcatctacgtggcgggaatggccgaacttggtgcattcttttccatattgcaggacatgcggaataccattatggcttcaaaaacggtaggcactgccgaggaaaagctgaaaaagaaaagtagcttctaccagtcttatctacgacgcacacaatccatggggatccagctcgatcagagaatcattctgctttacatgctggagtggggaaaggaaatggtggaccatttccacttgggcgatgacatggatcccgagctcaggggtctggctcaggccttaatcgaccaaaaggtcaaagagatttcaaaccaggaaccactgaagatatga

SEQ ID NO: 5758 - RNA, 1302 nt, synthetic construct
  misc_feature 1..1302: note = derived and/or modified CDS sequence (opt3) from PUUV(CG17/Baskiria-2001)__AF442613.1__N
  source 1..1302: mol_type = other RNA
atgagcgacctggccgatatccaggaggaaattaccagacacgagcaacagctcgtggctgcaaggcagaaacttaaagacgccgaacgggcggtcgaggttgatcccgacgatgtgaacaagaatacactgcaggctcgccaacagactgtatccgccttggaagacaaattagcagattacaagcgacgtatggccgacgctgtgtctagaaagaagatggatacgaagcctaccgacccaacaggcatagagccggatgaccatctgaaagagaggtcaagtctacggtatgggaacgtcctcgatgtgaatgcaatcgacattgaagaacccagcggacagactgccgactggtacaccatcggtgtttatgtgattggcttcacaatccctataatcctgaaggctctttacatgctgtccacccgcgggagacagactgtcaaagaaaacaagggaacaaggattcggtttaaagatgacacctctttcgaggatatcaatggcattcgccgaccaaagcacttgtatgtgtcgatgcccacggcccaatcaactatgaaggcggaggaactcacccctggtagatttaggacaatcgtatgcgggctgttcccaactcagatacaggttcggaacattatgagccccgtgatgggagtcatcggctttagtttctttgtgaaagactggcctgagaagattcgtgagttcatggagaaagaatgtccatttatcaagccggaggtgaaacccggcacccctgcacaggaggtcgagttcctgaagcgcaatagagtttactttatgacaaggcaagatgtgctcgacaaaaaccatgtagccgatatcgacaagttaattgattatgctgcctccggggacccaacctctcccgatgacatagaaagccctaatgcaccatgggtgttcgcttgcgcccccgaccggtgtccgcctacgtgcatctacgtcgcgggaatggccgaactgggtgcatttttctccattcttcaggatatgcgaaacactatcatggcttcaaagacagtgggcaccgccgaggaaaaattgaagaaaaagagtagcttctaccagtcttatctgcgcagaactcaatccatggggatacagctagaccagaggattatcctcctgtacatgcttgagtggggaaaagagatggttgatcactttcatctgggcgacgatatggaccccgaattgcggggtctcgctcagtcactgatcgatcaaaaggtgaaggagattagcaatcaggaaccattaaaaatctga

SEQ ID NO: 5759 - RNA, 1302 nt, synthetic construct
  misc_feature 1..1302: note = derived and/or modified CDS sequence (opt3) from PUUV(CG215)__AF367066.1__N
  source 1..1302: mol_type = other RNA
atgagcgacctgaccgatatccaggaggacattacaagacacgaacaacagctcgtggccgctaggcagaaacttaaagatgcagagcgggccgtcgaaatggaccccgatgacgttaacaagaatactctgcaggcgcgccaacagacggtgtccgctttggaggataaattagccgactacaagcgacgtatggcagatgccgtatctagaaagaagatggacaccaagcctgctgatccaacaggcatagaaccggacgatcatctgaaagagaggtcaagtctacggtatgggaacgtgctcgacgtcaatgcaatcgacattgaggaacccagcggacagactgccgattggtacaccatcggtgtgtatgttattggcttcacactgcctatcatacttaaggctctgtacatgttgtccacccgcgggagacagactgtgaaagagaacaagggaacaaggatccggtttaaagacgatacctctttcgaagacattaatggcatccgccgaccaaagcacctctatgtctcgatgcccacggcccaatcaactatgaaggcggaggagctgacccctggtagatttaggacaattgtgtgcgggctgttcccaactcagatccaggtacggaacataatgagccccgttatgggagtgattggctttagtttctttgtcaaagattggcctgaacgtatccgcgagttcatggaaaaggagtgtccatttattaaaccggaagtgaagcccggcacccctgcacaggagatcgagatgctcaaaaagaataaaatctacttcatgcatagacaagacgtgttagataagaaccacgtcgccgacattgataagctgatagactatgctgcctccggggatccaacatctcccgacaatatcgacagccctaacgcaccatgggtttttgcttgcgcccccgataggtgtccgcctacctgcatttacgtggcgggaatggccgaacttggtgcattcttttccatcttgcaggacatgcggaatacgataatggcttcaaaaactgtaggcacagccgaggaaaagctgaaaaagaaaagtagcttctaccagtcttatctacgacgcacccaatccatggggattcagctcgatcagagaatcatcctgctttacatgctggagtggggaaaggaaatggtggaccatttccacttgggcgatgacatggatcccgagctcaggggtctggctcagactttaattgaccaaaaggtcaaagagatctcaaaccaggaaccactgaagatttga

SEQ ID NO: 5760 - RNA, 1302 nt, synthetic construct
  misc_feature 1..1302: note = derived and/or modified CDS sequence (opt3) from PUUV(CG315)__AF367068.1__N
  source 1..1302: mol_type = other RNA
atgagcgacctgaccgatatccaggaggacattacaagacacgaacaacagctcgtggccgctaggcagaaacttaaagatgcagagcgggccgtcgaaatggaccccgatgacgttaacaagaatactctgcaggcgcgccaacagacggtgtccgctttggaggataaattagccgactacaagcgacgtatggcagatgccgtatctagaaagaagatggacaccaagcctgctgatccaacaggcatagaaccggacgatcatctgaaagagaggtcaagtctacggtatgggaacgtgctcgacgtcaatgcaatcgacattgaggaacccagcggacagactgccgattggtacaccatcggtgtgtatgttattggcttcacactgcctatcatacttaaggctctgtacatgttgtccacccgcgggagacagactgtgaaagagaacaagggaacaaggatccggtttaaagacgatacctctttcgaagacattaatggcatccgccgaccaaagcacctctatgtctcgatgcccacggcccaatcaactatgaaggcggaggagctgacccctggtagatttaggacaattgtgtgcgggctgttcccaactcagatccaggtacggaacataatgagccccgttatgggagtgattggctttagtttctttgtcaaagattggcctgaacgtatccgcgagttcatggaaaaggagtgtccatttatgaaaccggaagtgaagcccggcacccctgcacaggagattgagatgctcaaaaagaataaaatctacttcatgcatagacaagacgtgttagataagaaccacgtcgccgacatcgataagctgattgactatgctgcctccggggatccaacatctcccgacaatatagacagccctaacgcaccatgggtttttgcttgcgcccccgataggtgtccgcctacctgcatctacgtggcgggaatggccgaacttggtgcattcttttccattttgcaggacatgcggaatacgatcatggcttcaaaaactgtaggcacagccgaggaaaagctgaaaaagaaaagtagcttctaccagtcttatctacgacgcacccaatccatggggatacagctcgatcagagaattatcctgctttacatgctggagtggggaaaggaaatggtggaccatttccacttgggcgatgacatggatcccgagctcaggggtctggctcaggccttaatcgaccaaaaggtcaaagagatttcaaaccaggaaccactgaagatctga

SEQ ID NO: 5761 - RNA, 1302 nt, synthetic construct
  misc_feature 1..1302: note = derived and/or modified CDS sequence (opt3) from PUUV(CRF161)__AF367069.1__N
  source 1..1302: mol_type = other RNA
atgagcgacctgaccgatatccaggaggacattacaagacacgaacaacagctcgtggccgctaggcagaaacttaaagatgcagagcgggccgtcgaaatggaccccgatgacgttaacaagaatactctgcaggcgcgccaacagacggtgtccgctttggaggataaattagccgactacaagcgacgtatggcagatgccgtatctagaaagaagatggacaccaagcctgctgatccaacaggcatagaaccggacgatcatctgaaagagaggtcaagtctacggtatgggaacgtgctcgacgtcaatgcaatcgacattgaggaacccagcggacagactgccgattggtacaccatcggtgtgtatgttattggcttcacactgcctatcatacttaaggctctgtacatgttgtccacccgcgggagacagactgtgaaagagaacaagggaacaaggatccggtttaaagacgatacctctttcgaagacattaatggcatccgccgaccaaagcacctctatgtctcgatgcccacggcccaatcaactatgaaggcggaggagctgacccctggtagatttaggacaattgtgtgcgggctgttcccaactcagatccaggtacggaacataatgagccccgttatgggagtgattggctttagtttctttgtcaaagattggcctgaacgtatccgcgagttcatggaaaaggagtgtccatttattaaaccggaagtgaagcccggcacccctgcacaggagatcgagatgctcaaaaagaataaaatctacttcatgcatagacaagacgtgttagataagaaccacgtcgccgacattgataagctgatagactatgctgcctccggggatccaacatctcccgacaatatcgacagccctaacgcaccatgggtttttgcttgcgcccccgataggtgtccgcctacctgcatttacgtggcgggaatggccgaacttggtgcattcttttccatcttgcaggacatgcggaatacgataatggcttcaaaaactgtaggcacagccgaggaaaagctgaaaaagaaaagtagcttctaccagtcttatctacgacgcacccaatccatggggattcagctcgatcagagaatcatcctgctttacatgctggagtggggaaaggaaatggtggaccatttccacttgggcgatgacatggatcccgagctcaggggtctggctcaggccttaattgaccaaaaggtcaaagagatctcaaaccaggaaccactgaagatttga

SEQ ID NO: 5762 - RNA, 1302 nt, synthetic construct
  misc_feature 1..1302: note = derived and/or modified CDS sequence (opt3) from PUUV(CRF308)__AF367070.1__N
  source 1..1302: mol_type = other RNA
atgagcgacctgaccgatatccaggaggacattacaagacacgaacaacagctcgtggccgctaggcagaaacttaaagatgcagagcgggccgtcgaaatggaccccgatgacgttaacaagaatactctgcaggcgcgccaacagacggtgtccgctttggaggataaattagccgactacaagcgacgtatggcagatgccgtatctagaaagaagatggacaccaagcctgctgatccaacaggcatagaaccggacgatcatctgaaagagaggtcaagtctacggtatgggaacgtgctcgacgtcaatgcaatcgacattgaggaacccagcggacagactgccgattggtacaccatcggtgtgtatgttattggcttcacactgcctatcatacttaaggctctgtacatgttgtccacccgcgggagacagactgtgaaagagaacaagggaacaaggatccggtttaaagacgatacctctttcgaagacattaatggcatccgccgaccaaagcacctctatgtctcgatgcccacggcccaatcaactatgaaggcggaggagctgacccctggtagatttaggacaattgtgtgcgggctgttcccaactcagatccaggtacggaacataatgagccccgttatgggagtgattggctttagtttctttgtcaaagattggcctgaacgtatccgcgagttcatggaaaaggagtgtccatttattaaaccggaagtgaagcccggcacccctgcacaggagatcgagatgctcaaaaagaataaaatctacttcatgcatagacaagacgtgttagataagaaccacgtcgccgacatggataagctgattgactatgctgcctccggggatccaacatctcccgacaatatagacagccctaacgcaccatgggtttttgcttgcgcccccgataggtgtccgcctacctgcatctacgtggcgggaatggccgaacttggtgcattcttttccattttgcaggacatgcggaatacgatcatggcttcaaaaactgtaggcacagccgaggaaaagctgaaaaagaaaagtagcttctaccagtcttatctacgacgcacccaatccatggggatacagctcgatcagagaattatcctgctttacatgctggagtggggaaaggaaatggtggaccatttccacttgggcgatgacatggatcccgagctcaggggtctggctcaggccttaatcgaccaaaaggtcaaagagatttcaaaccaggaaccactgaagatctga

SEQ ID NO: 5763 - RNA, 1302 nt, synthetic construct
  misc_feature 1..1302: note = derived and/or modified CDS sequence (opt3) from PUUV(CRF366)__AF367071.1__N
  source 1..1302: mol_type = other RNA
atgaccgacctgacagatatccaggaggacattactagacacgaacaacagctcgtggccgctaggcagaaacttaaagatgcagagcgggccgtcgaaatggaccccgatgacgttaacaagaatacgctgcaggcgcgccaacagaccgtgagcgctttggaggataaattagccgactacaagcgacgtatggcagatgccgtatccagaaagaagatggacacaaagcctgctgatccaactggcatagaaccggacgatcatctgaaagagaggtcttcactacggtatgggaacgtgctcgacgtcaatgcaatcgacattgaggaacccagtggacagaccgccgattggtacacaatcggtatttatgtgatcggcttcaccctgcctataatccttaaggctctgtacatgttgagcactcgcgggagacagacagttaaagagaacaagggaaccaggattcggtttaaagacgatacgtccttcgaagacatcaatggcattcgccgaccaaagcacctctatgtgtctatgcccactgcccaatcgaccatgaaggcggaggagctgacacctggtagatttaggactatcgtctgcgggctgttcccaacccagatacaggtgcggaacattatgtcacccgtaatgggagttatcggctttagcttctttgtgaaagattggcctgaacgtattcgcgagttcatggaaaaggagtgtccatttatcaaaccggaagtcaagcccggcacccctgcacaggagatcgagatgctcaaaaagaataaaatttacttcatgcatagacaagacgtgttagataagaaccacgtggccgacatagataagctgatcgactatgctgccagtggggatccaacatcccccgacaatattgactctcctaacacgccatgggtctttgcatgcgctcccgataggtgtccgcctacttgcatctacgttgccggaatggcggaacttggtgccttctttagcatattgcaggacatgcggaatacaattatggcatccaaaaccgtgggcactgctgaggaaaagctgaaaaagaaatcaagtttctaccagagctatctacgacgcacacaatctatggggatccagctcgatcagagaatcattctgctttacatgctggagtggggaaaggaaatggtagaccatttccacttgggcgatgacatggatcccgagctcaggggtctggcccaggctttaatcgaccaaaaggtgaaagagatttccaaccaggaaccactgaagatatga

SEQ ID NO: 5764 - RNA, 1302 nt, synthetic construct
  misc_feature 1..1302: note = derived and/or modified CDS sequence (opt3) from PUUV(Djaknebole_98-1)__AM746310.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatgcgggctgtttccaacccagatccaggttaggaacataatgagccccgtgatgggagtcattggcttctcctttttcgtgaaggattgggccgaccggatccgtgaatttatggagaaagaatgtcctttcattaagccagaggtgaaaccgggcacacccacccaggaaatcgagtttctcaagaaaaataaggtctatttcatggatcgccaaaacgttttagacaagaatcatgtggcggatatcgacaaactgattgattacgcagccagtggggaccctacgtctccagacaacatagagagccccaatgctccttgggtatttgcctgcgcaccagatagatgtcccccgacttgcatctatgtggctggaatggccgaacttggtgcgttcttctccattttgcaggacatgaggaacacaatcatggcctcaaagaccgtcggcactgcagaggaaaaactgaagaaaaagagtagcttttaccagtcttacctacggcgaacacaatccatggggatacagctcgatcagcgcattatcctgctttatatgctggagtggggaaaggaaatggtggaccacttccatttgggcgatgacatggatcctgagctcagaggtctggctcaggccttaatcgaccaaaaagttaaggagatttcaaatcaggatcccctgaaaatctga

SEQ ID NO: 5765 - RNA, 1302 nt, synthetic construct
  misc_feature 1..1302: note = derived and/or modified CDS sequence (opt3) from PUUV(Fusong 114-05)__EF488804.1__N
  source 1..1302: mol_type = other RNA
atgagcgacctgaaggatatccaggaggacattgccagacacgaacaacagctcgtggtcgctaggcagaaacttcgggatgcagagaaggccgttgaaatggaccccgatgacgtgaacaaaaataccctgcaggcgcgccaacagacagtatccgctttggaggataagatagccgacttcaaacgacgtatggcagatatcgtgtctagaaagaagatggacactaaacctgccgatccaacgggcattgaaccggacgatcatttaaaggagaggtcaagtctgcggtacgggaacgtcctagacgtgaatgctatcgacattgaggaacccagcggacagaccgcagattggtatacaatcggtgtttacataatcgagtttactctccctattatcctgaaagccctttatatgctgtccacccgcggcagacagacagctaaggaaaacaaagggaccaggattcggttcaaggacgatacttcttttgaggacgtgaatggaatccgccgaccaaagcacttgtacgtctcgatgcccacagcccaatcaaccatgaaagcggaggaactcacgcctggcagattcaggactatagtgtgcggtctgtttccaacccagattcaggtacggaacatcatgagccccgttatgggggtgattggattctcctttttcgcaaaggattggcctgaccgtatcaaagagtttatggaaaaggagtgtccattcatcaaaccggaagtcaagcccggcacacccgccaaagaggtggagattctgaagcgcaataagatatattttatgcagagacaaggcgtgctcgataaaaaccatgtcccagacatcgataagttaattgactacgctgccagtggggatcccacttctcctaggaatatcgacagcccaaacgcaccctgggttttcgcttgcgccccggaccggtgtcctcctacctgcatatatgtggcgggaatggccgaactgggtgcatttttctccattcttcaggatatgcgaaatacaatcatggcttcaaaaaccgtaggcacggccgaggaaaagttgaaaaagaagagtagcttctaccagtcttacctgcgcagaactcaatccatggggatccagctagaccagaggattatcctcctgtatatgcttgagtggggaaaagaaatggtggatcactttcatctgggcgacgatatggacccagagttgcggtcactcgctcaggccctgattgatcaaaaggtcaaagagataagcaaccaggaacctttaaagatctga

SEQ ID NO: 5766 - RNA, 1302 nt, synthetic construct
  misc_feature 1..1302: note = derived and/or modified CDS sequence (opt3) from PUUV(Fusong 199-05)__EF488803.1__N
  source 1..1302: mol_type = other RNA
atgagcgacctgaaggatatccaggaggacattgccagacacgaacaacagctcgtggctgcaaggcagaaacttcgggatgccgagaaggcggtcgaaatggaccccgatgacgttaacaaaaataccctgcaggctcgccaacagacagtgtccgccttggaggataagatagcagacttcaaacgacgtatggccgatatcgtatctagaaagaagatggacactaaacctgctgatccaacgggcattgaaccggacgatcatttaaaggagaggtcaagtctgcggtacgggaacgtgctagacgtcaatgcaatcgacattgaggaacccagcggacagaccgccgattggtatacaatcggtgtgtacataatcggctttactctccctattatcctgaaagctctttatatgctgtccacccgcgggagacagacagttaaggagaacaaaggaaccaggattcggttcaaggacgatacttcttttgaagacgtgaatggcatccgccgaccaaagcacttgtacgtctcgatgcccacagcccaatcaaccatgaaagcggaggagctcacgcctggtagattcaggactatagtgtgcgggctgtttccaacccagattcaggtacggaacatcatgagccccgttatgggagtgattggcttctcctttttcgcaaaggattggcctgaccgtatcaaagaatttatggagaaggaatgtccattcatcaaaccggaggtcaagcccggcacacccgccaaagaagtggagattctgaagcgcaataagatatattttatgcagagacaagatgtgctcgacaaaaaccatgtcccagatatcgacaagttaattgattacgctgccagtggggaccccacttctcctgagaatatcgacagcccaaacgcaccctgggttttcgcttgcgccccggataggtgtcctcctacctgcatatatgtggcgggaatggccgaactgggtgcatttttctccattcttcaggacatgcggaatacaatcatggcttcaaaaaccgtaggcacggccgaggaaaagttgaaaaagaagagtagcttctaccagtcttacctgcgacgcactcaatccatggggatccagctagatcagagaattatcctcctgtatatgcttgagtggggaaaagaaatggtggaccactttcatctgggcgatgacatggatccagagttgaggtcactcgctcaggccctgattgaccaaaaggtcaaagagataagcaaccaggaacctttaaagatctga

SEQ ID NO: 5767 - RNA, 1302 nt, synthetic construct
  misc_feature 1..1302: note = derived and/or modified CDS sequence (opt3) from PUUV(Fusong 200-05)__EF211820.1__N
  source 1..1302: mol_type = other RNA
atgagcgacctgaaggatatccaggaggacattgccagacacgaacaacagctcgtggtcgctaggcagaaacttcgggatgcagagaaggccgttgaaatggaccccgatgacgtgaacaaaaataccctgcaggcgcgccaacagacagtatccgctttggaggataagatagccgacttcaaacgacgtatggcagatatcgtgtctagaaagaagatggacactaaacctgccgatccaacgggcattgaaccggacgatcatttaaaggagaggtcaagtctgcggtacgggaacgtcctagacgtgaatgctatcgacattgaggaacccagcggacagaccgcagattggtatacaatcggtgtttacataatcggctttactctccctattatcctgaaagccctttatatgctgtccacccgcgggagacagacagtgaaggagaacaaaggaaccaggattcggttcaaggacgatacttcttttgaagacgtcaatggcatccgccgaccaaagcacttgtacgtgtcgatgcccacagctcaatcaaccatgaaagccgaggagctcacgcctggtagattcaggactatagtatgcgggctgtttccaacccagattcaggttcggaacatcatgagccccgtgatgggagtcattggcttctcctttttcgcgaaggattggcctgaccgtatcaaagaatttatggagaaggaatgtccattcatcaaaccggaggtgaagcccggcacacccgcaaaagaagtggagattctgaagcgcaataagatatattttatgcagagacaagatgtcctcgacaaaaaccatgttccagatatcgacaagttaattgattacgccgctagtggggaccccacttctcctgagaatatcgacagcccaaacgccccctgggtgttcgcatgcgctccggataggtgtcctcctacctgcatatatgtagccggaatggcggaactgggtgcctttttctccattcttcaggacatgcggaatacaatcatggcatcaaaaaccgtgggcacggctgaggaaaagttgaaaaagaagagtagcttctaccagtcttacctgcgacgcactcaatccatggggatccagctagatcagagaattatcctcctgtatatgcttgagtggggaaaagaaatggtcgaccactttcatctgggcgatgacatggatccagagttgaggtcactcgcccaggctctgattgaccaaaaggtgaaagagataagcaaccaggaacctttaaagatctga

SEQ ID NO: 5768 - RNA, 1302 nt, synthetic construct
  misc_feature 1..1302: note = derived and/or modified CDS sequence (opt3) from PUUV(Fusong 900-06)__EF488806.1__N
  source 1..1302: mol_type = other RNA
atgagcgacctgaaggatatccaggaggacattgccagacacgaacaacagctcgtggtcgctaggcagaaacttcgggatgcagagaaggccgttgaaatggaccccgatgacgtgaacaaaaataccctgcaggcgcgccaacagacagtatccgctttggaggataagatagccgacttcaaacgacgtatggcagatatcgtgtctagaaagaagatggacactaaacctgccgatccaacgggcattgaaccggacgatcatttaaaggagaggtcaagtctgcggtacgggaacgtcctagacgtgaatgctatcgacattgaggaacccagcggacagaccgcagattggtatacaatcggtgtttacataatcggctttactctccctattatcctgaaagccctttatatgctgtccacccgcgggagacagacagtgaaggagaacaaaggaaccaggattcggttcaaggacgatacttcttttgaagacgtcaatggcatccgccgaccaaagcacttgtacgtgtcgatgcccacagctcaatcaaccatgaaagccgaggagctcacgcctggtagattcaggactatagtatgcgggctgtttccaacccagattcaggttcggaacatcatgagccccgtgatgggagtcattggcttctcctttttcgcgaaggattggcctgaccgtatcaaagaatttatggagaaggaatgtccattcatcaaaccggaggtgaagcccggcacacccgcaaaagaagtggagattctgaagcgcaataagatatattttatgcagagaagggatgtcctcgacaaaaaccatgttccagatatcgacaagttaattgattacgccgctagtggggaccccacttctcctgagaatatcgacagcccaaacgccccctgggtgttcgcatgcgctccggatcggtgtcctcctacctgcatatatgtagccggaatggcggaactgggtgcctttttctccattcttcaagacatgcgaaatacaatcatggcatcaaaaaccgtgggcacggctgaggaaaagttgaaaaagaagagtagcttctacaaatcttacctgcgcagaactcagtccatggggatccagctagatcaaaggattatcctcctgtatatgcttgagtggggaaaggaaatggtcgaccactttcatctgggcgatgacatggatccagagttgcggtcactcgcccaggctctgattgaccagaaagtgaaggagataagcaaccaggaacctttaaaaatctga

SEQ ID NO: 5769 - RNA, 1302 nt, synthetic construct
  misc_feature 1..1302: note = derived and/or modified CDS sequence (opt3) from PUUV(Gumboda_98-2)__AM746316.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatgcgggctgtttccaacccagatccaggttaggaacataatgagccccgtgatgggagtcattggcttctcctttttcgtgaaggattgggccgaccggatccgtgaatttatggagaaagaatgtcctttcattaagccagaggtgaaaccgggcacacccacccaggaaatcgagtttctcaagaaaaataaggtctatttcatggatcgccaaaacgttttagagaagaatcatgtggcggacatcgataaactgattgactacgcagccagtggggatcctacgtctccagacaacatagaaagccccaatgctccttgggtattttcctgcgccccagacagatgtcccccgacttgcatctatgtggcaggaatggctgagcttggtgccttcttctcaattttgcaggatatgaggaacacaatcatggcgagtaagaccgtcggcactgccgaagagaaactgaagaaaaagagctctttttaccagtcctacctacggcgaacacaatcaatggggatacagctcgaccagcgcattatcctgctttatatgctggaatggggaaaggagatggtggatcacttccatttgggcgacgatatggaccctgagctcagaggtctggcacaggctttaatcgatcaaaaagttaaggaaattagcaatcaggaccccctgaaaatctga

SEQ ID NO: 5770 - RNA, 1302 nt, synthetic construct
  misc_feature 1..1302: note = derived and/or modified CDS sequence (opt3) from PUUV(Gumboda_98-4)__AM746318.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatgcgggctgtttccaacccagatccaggttaggaacataatgagccccgtgatgggagtcattggcttctcctttttcgtgaaggattgggccgaccggatccgtgaatttatggagaaagaatgtcctttcattaagccagaggtgaaaccgggcacacccacccaggaaatcgagtttctcaagaaaaataaggtctatttcatggatcgccaaaacgttttagacaagaatcatgtggcggatatcgacaaactgattgattacgcagccagtggggaccctacgtctccagacaacatagagagccccaatgctccttgggtattttcctgcgccccagatagatgtcccccgacttgcatctatgtggcaggaatggctgaacttggtgccttcttctcaattttgcaggacatgaggaacacaatcatggcgagtaagaccgtcggcactgccgaggaaaaactgaagaaaaagagctctttttaccagtcctacctacggcgaacacaatcaatggggatacagctcgatcagcgcattatcctgctttatatgctggagtggggaaaggaaatggtggaccacttccatttgggcgatgacatggatcctgagctcagaggtctggcacaggctttaatcgaccaaaaagttaaggagattagcaatcaggatcccctgaaaatctga

SEQ ID NO: 5771 - RNA, 1302 nt, synthetic construct
  misc_feature 1..1302: note = derived and/or modified CDS sequence (opt3) from PUUV(Kamiiso-8Cr-95)__AB010730.1__N
  source 1..1302: mol_type = other RNA
atgagcgacctgaaggatatccaggaggacattaccagacacgaacaacagctcgtggtcgccaggcagaaacttcgggatgctgagaaggcagttgaaatggaccccgatgacgtgaacaaaaatacactgcaggcccgccaacagactgtatccgcgttggaggataagttagctgacttcaaacgacgtatggccgatgtggtctctagaaagaagatggacacgaaacctgcagatccaaccggcatagaaccggacgatcatctgaaggagaggtcaagtctacggtacgggaacgtgctcgacgttaatgccatcgacattgaggaacccagcggacagacagctgattggtatactatcggtgtgtacattatcggctttaccctgcctataatccttaaagcactgtatatgttgtccacacgcgggagacagaccgtcaaggagaacaaaggaactaggattcggttcaaggacgatacatcttttgaagacatcaatggcattcgccgaccaaagcacctctacgtgtcgatgcccaccgcccaatcaacgatgaaagctgaggagatcactcctggtagattcaggaccatagtatgcgggctgtttccaacacagattcaggttcggaacatcatgagccccgtgatgggagtcattggcttctcctttttcgtgaaggattggcctgaacgtatcaaagagtttatggaaaaggagtgtccattcatcaaaccggaagtgaagcccggcactcctgccaaagaggtcgagattctgaagcgcaataaggtttattttatgcagagacaagacgtgctcgataaaaaccatgtaccagacatagataagttaatcgactacgcggcaagtggggatcccacctctcctgacaatattgacagcccaaacgccccctgggtgttcgcttgcgccccggataggtgtcctcccacatgcatctatgtcgcaggaatggctgaactgggtgcctttttctccatacttcaggacatgcggaataccattatggcgtcaaaaacggtgggcactgccgaggaaaagttgaaaaagaagagtagcttctaccagtcttacctgcgacgcacacaatccatggggatccagctagatcagagaatcattctcctgtatatgcttgagtggggaaaagaaatggttgaccactttcatctgggcgatgacatggatccagagttgaggggtctcgcacaggctctgatcgaccaaaaggtgaaagagatttcaaaccaggaacctttaaagatatga

SEQ ID NO: 5772 - RNA, 1302 nt, synthetic construct
  misc_feature 1..1302: note = derived and/or modified CDS sequence (opt3) from PUUV(Mu/07/1219)__KJ994776.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgactacaaacgccgaatggccgatgcagtgtctcgtaagaagatggacaccaaacctacagatccaactggcatagaaccggacgatcatctgaaggagagatcaagtctaaggtatgggaacgtcctcgacgtgaatgccatcgacattgaggaacccagcggacagaccgctgattggtacacaatcggtgtttatgtgattggcttcaccctgcctatcatacttaaagcactgtacatgttgtccactcgggggcgccagacagtcaaggagaacaaaggaaccagaatcaggtttaaggacgatacgtctttcgaagacattaatggcatccggcgcccaaagcacctctatgtgtcgatgcccactgcccaatcaaccatgaaagctgaggagctgacacctggtcgatttagaactattgtatgcgggctgttcccaacccagatccaggttaggaacataatgagccccgtgatgggagtcattggctttagtttctttgtgaaggattgggccgaacggatccgtgagttcatggaaaaagagtgtccttttattaagccagaagtgaaaccgggcacacccgcgcaggaggcagagttcctcaagcgcaataaagtctactttatgcaaagacaggacgttttagataagaaccatgtggccgacatcgataagctgatcgactatgctgcctccggggatcctacctctccagacaatattgaaagccccaacgcaccttgggtattcgcttgcgccccagacaggtgtcccccgacgtgcatatacgtggcgggaatggccgagcttggtgcatttttctccatcttgcaggatatgcggaatactattatggcttcaaaaacagtcggcaccgccgaagagaagctgaaaaagaaaagtagcttctaccaatcttatctacgacgcactcagtccatggggatccagctcgaccagagaataattctgctttacatgctggaatggggaaaggagatggtggatcactttcatttgggcgacgatatggaccctgagctcaggggtctggctcaagccttaatcgatcagaaggttaaagaaatctcaaaccaggagcccctgaagatttga

SEQ ID NO: 5773 - RNA, 1302 nt, synthetic construct
  misc_feature 1..1302: note = derived and/or modified CDS sequence (opt3) from PUUV(Opina916)__AF294652.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctgtcgatccaacaggcatagaaccggacgatcatctgaaggagagatcaagtctaaggtacgggaacgtgctcgacgttaatgccatcgacattgaggaacccagcggacagactgctgattggtataccatcggtgtgtacgtcattggctttacactgcctatcatacttaaagcactgtatatgttgtccacccgggggcgccagactgtgaaggagaacaaaggaacaagaatcaggttcaaggacgatacctcttttgaagacattaatggcatccggcgcccaaagcacctctacgtatcgatgcccacggcccaatcaactatgaaagctgaggagctgacccctggtcgattcagaacaattgtttgcgggctgtttccaactcagatccaggtgaggaacataatgagccccgtcatgggagtgattggcttctcctttttcgtgaaggattgggccgaacggatccgtgagtttatggaaaaagagtgtcctttcattaagccagaagtcaaaccgggcacccccgcgcaggaggcagagtttctcaagaaaaatcgcatctatttcatgcaaagacaggaagttttagacaagaaccatgtggccgatatcgacaagctgattgattacgctgccagtggggaccctacatctccagataatatagagagccccaacgcaccttgggtatttgcttgcgccccagacaggtgtcccccgacctgcatctatgtggcgggaatggccgaacttggtgcattcttctccattttgcaggacatgcggaatacgatcatggcttcaaaaactgtcggcacagccgaggaaaagctgaaaaagaaaagtagcttttaccaatcttacctacgacgcacccagtccatggggatacagctcgatcagagaattatcctgctttatatgctggagtggggaaaggagatggtggaccacttccatttgggcgatgacatggatcctgaactcaggggtctggctcaagccttaatcgaccagaaggttaaagagatttcaaaccaggaacccctgaagatctga

SEQ ID NO: 5774 - RNA, 1302 nt, synthetic construct
  misc_feature 1..1302: note = derived and/or modified CDS sequence (opt3) from PUUV(Palbole_98-1)__AM746327.1__N
  source 1..1302: mol_type = other RNA
atgagcgacctgaccgatatccaggaggacattacatgccacgaacaacagctcgtggtcgccagacagaaacttaaggatgctgagaaggcagttgaaatggaccccgatgacgtgaacaaaaatactctgcaggccaggcaacagacggtatccgcgttggaggataagttagctgacttcaaacggcgcatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcagacagtcaaggagaacaaaggaacccgcatcagattcaaggacgatacgtcttttgaagacattaatggcatcaggcggccaaagcacctctacgtgtcgatgcccactgcccaatcaaccatgaaagctgaggagctgacacctggtcgcttccgaactattgtatgtgggctgtttccaacccagatccaggttagaaacataatgagccccgtgatgggagtcattggcttctcctttttcgtgaaggattgggccgacaggatccgggaatttatggagaaagaatgccctttcattaagccagaggtgaaaccgggcacacccacccaggaaatcgagtttctcaagaaaaataaggtctatttcatggatcgtcaaaacgttttagacaagaatcatgtggcggatatcgacaaactgattgattacgcagccagtggggaccctacgtctccagacaacatagagagccccaatgctccttgggtatttgcctgtgcaccagatcgctgtcccccgacttgcatctatgtggctggaatggccgaacttggtgcgttcttctccattttgcaggacatgagaaacacaatcatggcctcaaagaccgtcggcactgcagaggaaaaactgaagaaaaagagtagcttttaccagtcttacctaaggcggacacaatccatggggatacagctcgatcagcgaattatcctgctttatatgctggagtggggaaaggaaatggtggaccacttccatttgggcgatgacatggatcctgagctccgcggtctggctcaggccttaatcgaccaaaaagttaaggagatttcaaatcaggatcccctgaaaatctga

SEQ ID NO: 5775 - RNA, 1302 nt, synthetic construct
  misc_feature 1..1302: note = derived and/or modified CDS sequence (opt3) from PUUV(Palbole_98-2)__AM746328.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatgcgggctgtttccaacccagatccaggttaggaacataatgagccccgtgatgggagtcattggcttctcctttttcgtgaaggattgggccgaccggatccgtgaatttatggagaaagaatgtcctttcattaagccagaggtgaaaccgggcacacccacccaggaaatcgagtttctcaagaaaaataaggtctatttcatggatcgccaaaacgttttagacaagaatcatgtggcggatatcgacaaactgattgattacgcagccagtggggaccctacgtctccagacaacatagagagccccaatgctccttgggtatttgcctgcgcaccagatagatgtcccccgacttgcatctatgtggctggaatggccgaacttggtgcgttcttctccattttgcaggacatgaggaacacaatcatggcctcaaagaccgtcggcactgcagaggaaaaactgaagaaaaagagtagcttttaccagtcttacctacggcgaacacaatccatggggatacagctcgatcagcgcattatcctgctttatatgctggagtggggaaaggaaatggtggaccacttccatttgggcgatgacatggatcctgagctcagaggttttgctcaggccctgatcgaccaaaaagttaaggagatttcaaatcaggatcccttaaaaatctga

SEQ ID NO: 5776 - RNA, 1302 nt, synthetic construct
  misc_feature 1..1302: note = derived and/or modified CDS sequence (opt3) from PUUV(Palbole_98-3)__AM746329.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatgcgggctgtttccaacccagatccaggttaggaacataatgagccccgtgatgggagtcattggcttctcctttttcgtgaaggattgggccgaccggatccgtgaatttatggagaaagaatgtcctttcattaagccagaggtgaaaccgggcacacccacccaggaaatcgagtttctcaagaaaaataaggtctatttcatggatcgccaaaacgttttagacaagaatcatgtggcggatatcgacaaactgattgattacgcagccagtggggaccctacgtctccagacagcatagagtcccccaacgctccttgggtatttgcctgcgcaccagatagatgtcccccgacttgcatctatgtggctggaatggccgaacttggtgcgttcttctcaattttgcaggacatgaggaatacaatcatggccagtaagaccgtcggcactgcagaggaaaaactgaagaaaaagagctctttttaccagtcctacctacggcgaacacaatcaatggggatacagctcgatcagcgcattatcctgctttatatgctggagtggggaaaggaaatggtggaccacttccatttgggcgatgacatggatcctgagctcagaggtctggctcaggccttaatcgaccaaaaagttaaggagattagcaaccaggatcccctgaaaatctga

SEQ ID NO: 5777 - RNA, 1302 nt, synthetic construct
  misc_feature 1..1302: note = derived and/or modified CDS sequence (opt3) from PUUV(PUUV/Ardennes/Mg156/2011)__KT247592.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggccaaagcacctctacgtgtcgatgcccactgcccagtcaaccatgaaagctgaggagctgacacctggtcgcttccgaactattgtatgcgggctgtttccaacccagatccaggttagaaacataatgagccccgtgatgggagtcattggcttctcctttttcgtgaaggattgggccgacaggatccgggaatttatggagaaagaatgtcctttcattaagccagaggtgaaaccgggcacacccgcgcaagaagtcgagtttctcaagcgtaataaaatctatttcatgcagcgccaggatgttttagacaagaaccatgtggcagatatcgacaagctgattgattacgccgctagtggggaccctacctctccagacaatatagaggcccccaacgcaccttgggtatttgcttgcgccccagatagatgtcccccgacgtgcatctatgtggcgggaatggccgaacttggtgcattcttcagcattttgcaagacatgaggaatactatcatggcttccaaaacagtcggcaccgccgaggaaaagctgaaaaagaaatcaagtttttaccagagctacctacggcgaactcagtctatggggatacagctcgatcaacgcattatcctgctttatatgctggagtggggaaaggaaatggtggaccacttccatttgggcgatgacatggatcctgagctcagaggtctggctcaggccttaatcgaccagaaggttaaagagatttccaaccaggaacccctgaagatctga

SEQ ID NO: 5778 - RNA, 1302 nt, synthetic construct
  misc_feature 1..1302: note = derived and/or modified CDS sequence (opt3) from PUUV(PUUV/Jelgava/Mg136/2008)__JN657230.1__N
  source 1..1302: mol_type = other RNA
atgagcgacctggccgatatccaggaggacattaccagacacgaacaacagctcgtggtcgctaggcagaaacttaaagatgcagagcgggccgttgaagtggaccccgatgacgtaaacaagaatacactgcaggcgcgccaacagactgtgtccgctttggaggataaattagccgactacaagcgacgtatggcagatgccgtctctagaaagaagatggacacgaagcctgctgatccaaccggcatagaaccggacgatcatctgaaagagaggtcaagtctacggtatgggaacgtgctcgacgttaatgcaatcgacattgaggaacccagcggacagacagccgattggtacactatcggtgtgtatgtcattggcttcaccctgcctatcatacttaaggctctgtacatgttgtccacacgcgggagacagaccgtgaaagagaacaagggaactaggatccggtttaaagacgatacatctttcgaagacattaatggcatccgccgaccaaagcacctctatgtatcgatgcccaccgcccaatcaacgatgaaggcggaggagctgactcctggtagatttaggaccgttgtgtgcgggctgttcccaacacagattcaggtccggaacatcatgagccccgtgatgggagtgataggctttagtttctttgtcaaagattggcctgaccgtattaaggagttcatggaaaaagaatccccatttatcaagccggatgttaaacccggcactcctgcacaggaggtggagttcctcaagcgcaataaagtatactttatgaacagacaagacgtgttagataagaatcatgtcgccgacattgataagctgatcgactatgctgcctctggggacccaaccagccccgatgacatcgaatcccctaacgcaccatgggtgttcgcttgtgcccccgataggtgcccgcctacatgtatttacgttgcgggaatggccgagcttggtgcatttttctcaatattgcaggacatgcggaataccatcatggctagtaaaacggtgggcactgccgaagagaagctgaaaaagaaaagctctttctaccagtcctatctacgacgcacacaatcaatggggattcagctcgatcagagaatcatactgctttacatgctggaatggggaaaggagatggtcgaccactttcatttgggcgatgacatggatcccgaactcaggggtctggctcaggccttaattgaccaaaaggtgaaagagatcagcaaccaggagccactgaagatctga

SEQ ID NO: 5779 - RNA, 1302 nt, synthetic construct
  misc_feature 1..1302: note = derived and/or modified CDS sequence (opt3) from PUUV(PUUV/Jelgava/Mg140/2008)__JN657231.1__N
  source 1..1302: mol_type = other RNA
atgagcgacctggccgatatccaggaggacattaccagacacgaacaacagctcgtggtcgctaggcagaaacttaaagatgcagagcgggccgttgaagtggaccccgatgacgtaaacaagaatacactgcaggcgcgccaacagactgtgtccgctttggaggataaattagccgactacaagcgacgtatggcagatgccgtctctagaaagaagatggacacgaagcctgctgatccaaccggcatagaaccggacgatcatctgaaagagaggtcaagtctacggtatgggaacgtgctcgacgttaatgcaatcgacattgaggaacccagcggacagacagccgattggtacactatcggtgtgtatgtcattggcttcaccctgcctatcatacttaaggctctgtacatgttgtccacacgcgggagacagaccgtgaaagagaacaagggaactaggatccggtttaaagacgatacatctttcgaagacattaatggcatccgccgaccaaagcacctctatgtatcgatgcccaccgcccaatcaacgatgaaggcggaggagctgactcctggtagatttaggaccgttgtgtgcgggctgttccatacacagattcaggtccggaacatcatgagcccagtgatgggagtgataggctttagtttctttgtcaaagattggcccgaccgtattaaggagttcatggaaaaagaatgtccttttatcaagccagatgttaaaccgggcactcccgcacaggaggtggagttcctcaagcgcaataaagtatactttatgaacagacaagacgtgttagataagaatcacgtcgccgacattgataagctgatcgactatgctgcctccggggaccctacctctccagatgacatcgaaagccccaacgcaccttgggtgttcgcttgcgccccagataggtgtcccccgacatgcatttacgttgcgggaatggccgagcttggtgcatttttctccatattgcaggacatgcggaataccatcatggcttcaaaaacggtgggcactgccgaagagaagctgaaaaagaaaagtagcttctaccagtcttatctacgacgcacacaatccatggggattcagctcgatcagagaatcatactgctttacatgctggaatggggaaaggagatggtcgaccattttcacttgggcgatgacatggatcctgaactcaggggtctggctcaggccttaattgaccaaaaggtgaaagagatctcaaaccaggagcccctgaagatctga

SEQ ID NO: 5780 - RNA, 1302 nt, synthetic construct
  misc_feature 1..1302: note = derived and/or modified CDS sequence (opt3) from PUUV(PUUV/Jura/Mg2/2010)__KT247596.2__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatgcgggctgtttccaacccagatccaggttaggaacataatgagccccgtgatgggagtcattggcttctcctttttcgtgaaggattgggccgaccggatccgtgaatttatggagaaagaatgtcctttcattaagccagagatcaaaccgggcacacccgcgcaggaagcagagtttctcaagcgcaataaaatctatttcatgcaaagacaggatgtgttagacaagaaccatgtcgccgatattgacaagctgatagattacgctgccagtggggaccctacctctccagacaatatcgagagccccaacgcaccttgggtttttgcttgcgccccagataggtgtcccccgacgtgcatttatgtggcgggaatggccgaacttggtgcattcttctccatcttgcaggacatgcggaatactataatggcttcaaaaacagtaggcaccgccgaggaaaagctgaaaaagaaaagtagcttttaccaatcttacctacgacgcactcagtccatggggattcagctcgatcagagaatcatcctgctttatatgctggagtggggaaaggaaatggtggaccacttccatttgggcgatgacatggatcctgagctcaggggtctggctcaagccttaattgaccagaaggtcaaagagatctcaaaccaggaacccctgaagatttga

SEQ ID NO: 5781 - RNA, 1302 nt, synthetic construct
  misc_feature 1..1302: note = derived and/or modified CDS sequence (opt3) from PUUV(PUUV/Madona/Mg233/2008)__JN657232.1__N
  source 1..1302: mol_type = other RNA
atgagcgacctggccgatatccaggaggacattaccagacacgaacaacagctcgtggtcgctaggcagaaacttaaagatgcagagcgggccgttgaagtggaccccgatgacgtaaacaagaatacactgcaggcgcgccaacagactgtgtccgctttggaggataaattagccgactacaagcgacgtatggcagatgccgtctctagaaagaagatggacacgaagcctaccgatccaacaggcatagaaccggacgatcatctgaaagagaggtcaagtctacggtatgggaacgtgctcgacgttaatgctatcgacattgaggaacccagcggacagactgcagattggtacaccatcggtgtgtatgtcatttccttcacactgcctatcatacttaaggccctgtacatgttgtctacccgcggcagacagactgtgaaagagaacaaggggacaaggatccggtttaaagacgatacctcgttcgaagacattaatggaatccgccgaccaaagcacctctatgtatcaatgcccacggctcaaagcactatgaaggccgaggagctgacccctggcagatttaggacaattgtttgcggtctgttcccaactcagatccaggtgcggaacataatgagtcccgtcatgggggtgattggattttccttctttgtgaaagattggcctgaccgtatcaaggagttcatggaaaaagaatgtccatttattaagccggatgtcaaacccggcacccctgcgcaggagatcgagttcctcaagcgcaataaagtttactttatgaacagacaagacgtgttagataagaatcatgtagcagacatcgataagctgattgactatgccgcttctggcgacccaacaagccccgatgacatagaatcccctaacgccccatgggtgttcgcatgcgctcccgataggtgtccgcctacctgcatctacgtcgccgggatggcggagcttggagcctttttctcaattttgcaggacatgcggaatacgatcatggcaagtaaaactgtgggtacagctgaagagaagctgaaaaagaaaagctctttctaccagtcctatctacgacgcacccaatcaatgggcatacagctcgatcagagaattatcctgctttacatgctggaatgggggaaggagatggttgaccactttcatttgggagatgacatggatcccgaactcaggggcctggcccaggctttaatcgaccaaaaggtgaaagagattagcaaccaggagccactgaagatctga

SEQ ID NO: 5782 - RNA, 1302 nt, synthetic construct
  misc_feature 1..1302: note = derived and/or modified CDS sequence (opt3) from PUUV(PUUV/Orleans/Mg23/2010)__KT247594.1__N
  source 1..1302: mol_type = other RNA
atgagcgacctgaccgatatccaggaggtgattacaagacacgaacaacagctcgtcgttgccaggcagaaacttaaggacgctgagaaggcagtggaaatggatcccgacgatgtaaacaaaaatactctgcaggcccggcaacagacggtgtccgcgttggaggacaagttagctgatttcaaacgccgaatggccgacgcagtctctcgtaagaagatggataccaaacctgccgacccaacaggcatagaaccggatgaccatctgaaggagagatcaagtctaaggtacgggaacgtgctcgatgttaatgctatcgacattgaggaacccagcggacagactgcagactggtataccatcggtgtgtacgtcattggctttacactgcctatcatacttaaagccctgtatatgttgtccacccgggggcgccagactgtgaaggagaacaaaggaacaagaatcaggttcaaggatgacacctcttttgaagatattaatggcatccggcgcccaaagcacctctacgtatcgatgcccacggctcaatcaactatgaaagccgaggagctgacccctggtcgattcagaacaattgtttgcgggctgtttccaactcagatccaggtgaggaacataatgagccccgtcatgggagtgattggcttctcctttttcgtgaaggactgggcggatcggatcaaagaatttatggagaaggaatgtcctttcattaaaccagaggtcaagccgggcacccccgttaaagaagcagagtttctcaagaagaatcgtgtgtatttcatgcagcgccaagacgtattagataaaaaccatgtggccgacatcgataagctgatcgactacgctgccgcaggggatcctacaagtccagacaatattgagtctcccaacgctccttgggtctttgcctgcgcgccagacagatgtcccccgacctgcatatatgtggccggaatggcagaacttggtgctttcttcagcatcttgcaggatatgaggaatacgattatggcctccaaaactgttggcacagctgaggaaaagctgaaaaagaagtcaagtttttaccagagctacctacggcgaacccaatctatggggatccagctcgaccagcgcataattctgctttatatgctggagtggggaaaagaaatggtggatcacttccatttgggcgacgatatggaccctgagctcagaggtctggcccaggcattaatcgatcaaaaggtcaaagagatctccaaccaggaacccctgaagatttga

SEQ ID NO: 5783 - RNA, 1302 nt, synthetic construct
  misc_feature 1..1302: note = derived and/or modified CDS sequence (opt3) from PUUV(Tobetsu-60Cr-93)__AB010731.1__N
  source 1..1302: mol_type = other RNA
atgagcgacctgaaggatatccaggaggacattaccagacacgaacaacagctcgtggtcgccaggcagaaacttcgggatgctgagaaggcagttgaaatggaccccgatgacgtgaacaaaaatacactgcaggcccgccaacagactgtatccgcgttggaggataagttagctgacttcaaacgacgtatggccgatgtggtctctagaaagaagatggacacgaaacctgcagatccaaccggcatagaaccggacgatcatctgaaggacaggtcaagtctacggtacgggaacgtgctcgacgttaatgccatcgatattgaggagcccagcggacagacagctgactggtatactatcggtgtgtacattatcggctttaccctgcctataatccttaaagcactgtatatgttgtccacacgcgggagacagaccgtcaaggaaaacaaaggaactaggattcggttcaaggatgacacatcttttgaggatatcaatggcattcgccgaccaaagcacctctacgtgtcgatgcccaccgcccaatcaacgatgaaagctgaagagatcactcctggtagattcaggaccatagtatgcgggctgtttccaacacagattcaggttcggaacatcatgagccccgtgatgggagtcattggcttctcctttttcgtgaaggactggcctgagcgtatcaaagaatttatggagaaggaatgtccattcatcaaaccggaggtgaagcccggcactcctgccaaagaagtcgagattctgaagcgcaataaggtttattttatgcagagacaagatgtgctcgacaaaaaccatgtaccagatatagacaagttaatcgattacgcggcaagtggggaccccacctctcctgacaatattgatagcccaaacgccccctgggtgttcgcttgcgccccggacaggtgtcctcccacatgcatctatgtcgcaggaatggctgagctgggtgcctttttctccatacttcaggatatgcggaataccattatggcgtcaaaaacggtgggcactgccgaagagaagttgaaaaagaagagtagcttctaccagtcttacctgcgacgcacacaatccatggggatccagctagaccagagaatcattctcctgtatatgcttgaatggggaaaagagatggttgatcactttcatctgggcgacgatatggacccagaattgaggggtctcgcacaggctctgatcgatcaaaaggtgaaagagatttcaaaccaggagcctttaaagatatga

SEQ ID NO: 5784 - RNA, 1302 nt, synthetic construct
  misc_feature 1..1302: note = derived and/or modified CDS sequence (opt3) from PUUV(Vranica)__U14137.1__N
  source 1..1302: mol_type = other RNA
atgagcgacctgaccgatatccaggaggacattacaagacacgaacaacagctcgtggtcgccaggcagaaacttaaggatgctgagaaggcagttgaaatgtaccccgacgatgtgaacaaaaatactctgcaggcccggcaacagacggtatccgcgttggaggacaagttagctgatttcaaacgccgaatggccgacgcagtgtctcgtaagaagatggataccaaacctacagacccaactggcatagaaccggatgaccatctgaaggagagatcaagtctaaggtatgggaacgtcctcgatgtgaatgccatcgacattgaggaacccagcggacagaccgctgactggtacacaatcggtgtttatgtgattggctttaccctgcctatcatacttaaagcactgtacatgttgtccactcgggggcgccagacagtcaaggagaacaaaggaaccagatataggttcaaggatgacacgtcttttgaagatatcaatggcattcggcgcccaaagcacctctacgtgtcgatgcccactgcccaatcaaccatgaaagctgaggagctgacacctggtcgattcagaactatcgtatgcgggctgtttccaacccagattcaggttaggaacatcatgagccccgtgatgggagtcataggcttctcctttttcgtgaaggactgggccgatcggattcgtgaatttatggagaaagaatgtcctttcatcaagccagaggtgaaaccgggcacacccacccaggaaattgagtttctcaagaaaaataaggtctatttcatggaccgccaaaacgttttagataagaatcatgtggcggacatcgataaactgatcgactacgcagccagtggggatcctacgtctccagacaacattgagagccccaatgctccttgggtatttgcctgcgcaccagacagatgtcccccgacttgcatatacgtggctggaatggccgaacttggtgcgttcttctccatcttgcaggatatgaggaacacaattatggcctcaaagaccgtcggcactgcagaggaaaaactgaagaaaaagagtagcttttatcagtcttacctacggcgaacacaatccatggggatccagctcgaccagcgcataattctgctttatatgctggagtggggaaaggaaatggtggatcacttccatttgggcgacgatatggaccctgagctcagaggtctggctcaggccttaatcgatcaaaaagttaaggagatctcaaatcaggaccccctgaaaatttga

SEQ ID NO: 5785 - RNA, 1302 nt, synthetic construct
  misc_feature 1..1302: note = derived and/or modified CDS sequence (opt3) from PUUV(P360)__L11347.1__N
  source 1..1302: mol_type = other RNA
atgagcgacctgaccgatatccaggaggaaattacaagacacgagcaacagctcgtggtcgccaggcagaaacttaaagacgctgaacgggcagttgaggtgtaccccgatgacgtaaacaagaatactctgcaggcccgccaacagacggtgtccgcgttggaagataaattagctgactataagcgacgtatggccgatgcagtctctagaaagaagatggacaccaagcctacagatccaactggcatagagccggacgatcatctgaaagagaggtcaagtctacggtacgggaacgtgctcgacgttaatgccatcgatattgaagaacccagcggacagaccgctgactggtatacaatcggtgtgtacgtcattggcttcaccatccctataatcctgaaggcactttatatgctgtccactcgcgggagacagacagtgaaagaaaacaagggaaccaggattcggtttaaagacgatacgtctttcgaggacatcaatggcattcgccgaccaaagcacttgtacgtatcgatgcccactgcccaatcaaccatgaaggctgaggaactcacacctggtagatttaggactatcgtttgcgggctgttcccaacccagatacaggtgcggaacattatgagccccgtcatgggagtgatcggctttagtttctttgtgaaagattggcctgagaagattcgtgagttcatggagaaagaatgtccatttatcaagccggaggtcaaacccggcacccctgcccaggaggttgagttcctgaagcgcaatagagtgtattttatgacaaggcaagacgtactcgataaaaaccatgtggcggacatcgataagttaattgactacgcagcctccggggatccaacgtctcccgacgatatagaaagccctaatgctccatgggtcttcgcctgcgcacccgaccggtgtccgcctacttgcatctacgtggctggaatggccgaactgggtgcgtttttctccattcttcaggacatgcgaaacacaatcatggcctcaaagaccgttggcactgcagaggaaaaattgaagaaaaagagtagcttctatcagtcttacctgcgcagaacacaatccatggggatacagctagatcagaggattatcctcctgtatatgcttgagtggggaaaagagatggtggaccactttcatctgggcgatgacatggatcccgaattgcggggtctcgctcagtcactgatcgaccaaaaggtcaaggagattagcaatcaggaaccattaaaaatctga

SEQ ID NO: 5786 - RNA, 1302 nt, synthetic construct
  misc_feature 1..1302: note = derived and/or modified CDS sequence (opt3) from PUUV(Aijajarvi/Mg7/05)__GQ339476.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggccaaagcacctctacgtgtcgatgcccactgcccagtcaaccatgaaagctgaggagctgacacctggtcgcttccgaactattgtatgcgggctgtttccaacccagatccaggttagaaacataatgagccccgtgatgggagtcattggcttctcctttttcgtgaagggctgggccgataggatccgggaatttatggagaaagaatgtcctttcattaagccagaggtgaaaccggggacacccacccaagaagtcgagtttctcaagaaaaataaggtttatttcttagaccgtcagaacgtgctggataagaatcatgtagcggacatcgataaacttatcgactacgcagccagtggagatcctacgtctccagacaacattgagagccccaatgctccttgggtgtttgcctgcgcaccagaccgctgtcccccgacttgcatatatgtcgctggtatggccgaattgggcgcgttcttctccatcctgcaggatatgagaaacacaattatggcctcaaagaccgtggggactgcagaggaaaaactaaagaaaaagagtagcttttaccaatcttacctcaggcggacacagtccatgggaatccagctggaccagcgaataattcttctgttcatgttggagtggggcaaggaaatggttgatcactttcatctcggtgacgatatggaccctgagctgcgcgggttagctcaagccctgatcgatcagaaagtgaaggagatctcaaatcaggaacccctcaaaatttga

SEQ ID NO: 5787 - RNA, 1302 nt, synthetic construct
  misc_feature 1..1302: note = derived and/or modified CDS sequence (opt3) from PUUV(Bavaria 151/05)__EU439968.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgactacaaacgccgaatggccgatgcagtgtctcgtaagaagatggacaccaaacctacagatccaactggcatagaaccggacgatcatctgaaggagagatcaagtctaaggtatgggaacgtcctcgacgtgaatgccatcgacattgaggaacccagcggacagaccgctgattggtacacaatcggtgtttatgtgattggcttcaccctgcctatcatacttaaagcactgtacatgttgtccactcgggggcgccagacagtcaaggagaacaaaggaaccagaatcaggtttaaggacgatacgtctttcgaagacattaatggcatccggcgcccaaagcacctctatgtgtcgatgcccactgcccaatcaaccatgaaagctgaggagctgacacctggtcgatttagaactattgtatgcgggctgttcccaacccagatccaggttaggaacataatgagccccgtgatgggagtcattggctttagtttctttgtgaaggattgggccgaacggatccgtgagttcatggaaaaagagtgtccttttctcaagccagaaattaaaccgggcacacccgcgcaggaggcagagttcttaaagaaaaataaggtgtactttatgcaacgccaggacgtcctggataagaaccatgttgccgacatcgataaacttatcgactatgctgcctccggggatcctacctctccagacaatattgaaagccccaacgcaccttgggtgttcgcttgcgccccagacagatgtcccccgacgtgcatatacgtagcgggaatggccgagttgggtgcatttttctccatcctgcaggatatgaggaatactattatggcttcaaagacagtgggcaccgccgaagagaaactaaagaaaaagagtagcttctaccaatcttatctccggcgaactcagtccatggggatccagctggaccagcgcataattcttctgtacatgttggaatggggaaaggagatggtcgatcactttcatctcggcgacgatatggaccctgagctgagaggtttagctcaagccctgatcgatcagaaagtgaaggaaatctcaaaccaggagcccctcaaaatttga

SEQ ID NO: 5788 - RNA, 1302 nt, synthetic construct
  misc_feature 1..1302: note = derived and/or modified CDS sequence (opt3) from PUUV(Bavaria 159/05)__EU439972.1__N
  source 1..1302: mol_type = other RNA
atgagcgacctgaccgatatccacgaggacattacaagacatgaacagcaactcgtggtcgccaggcagaaacttaaggatgctgagaaggcagttgaaatggaccccgatgacgtgaacaaaaatactctgcaggcccggcagcaaacggtatccgcgttggaggataagttagctgactacaaacgccgaatggccgatgcagtgtctcgtaagaagatggacaccaaacctacagatccaactggcatagaaccggacgatcacctgaaggagagatcaagtctaaggtatgggaacgtcctcgacgtgaatgccatcgacattgaggaacccagcggacagaccgctgattggtacacaatcggtgtttatgtgattggcttcaccctgcctatcatacttaaagcactgtacatgttgtccactcgggggcgccagacagtcaaggagaacaaaggaaccagaatcaggtttaaggacgatacgtctttcgaagacattaatggcatccggcgcccaaagcatctctatgtgtcgatgcccactgcccagtcaaccatgaaagctgaggagctgacacctggtcgatttagaactattgtatgcgggctgttcccaacccaaatccaggttaggaacataatgagccccgtgatgggagtcattggctttagtttctttgtgaaggattgggccgaacggatccgtgagttcatggaaaaagagtgtccttttattaagccagaaatcaaaccgggcacacccgcgcaggaggcagagttcctcaagcgcaataaagtgtactttatgcagagacaagacgtcttagataagaaccacgttgccgacatcgataagctgattgactatgctgcctccggggatcctacctctccagacaatatagaaagccccaacgcaccttgggtgttcgcttgcgccccagacaggtgtcccccgacgtgcatctacgtagcgggaatggccgagcttggtgcatttttctccattttgcaggatatgcggaatactatcatggcttcaaaaacagtgggcaccgccgaagagaagctgaaaaagaaaagtagcttctaccagtcttatctacgacgcactcaatccatggggatacagctcgaccagagaattatcctgctttacatgctggaatggggaaaggagatggtcgatcattttcacttgggcgacgatatggaccctgagctcaggggtctggctcaggccttaatcgatcaaaaggtgaaagaaatttcaaaccaggagcccctgaagatctga

SEQ ID NO: 5789 - RNA, 1299 nt, synthetic construct
  misc_feature 1..1299: note = derived and/or modified CDS sequence (opt3) from PUUV(Bavaria CG 33/04)__DQ016430.2__N
  source 1..1299: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgactacaaacgccgaatggccgatgcagtgtctcgtaagaagatggacaccaaacctacagatccaactggcatagaaccggacgatcatctgaaggagagatcaagtctaaggtatgggaacgtcctcgacgtgaatgccatcgacattgaggaacccagcggacagaccgctgattggtacacaatcggtgtttatgtgattggcttcaccctgcctatcatacttaaagcactgtacatgttgtccactcgggggcgccagacagtcaaggagaacaaaggaaccagaatcaggtttaaggacgatacgtctttcgaagacattaatggcatccggcgcccaaagcacctctatgtgtcgatgcccactgcccaatcaaccatgaaagctgaggagctgacacctggtcgatttagaactattgtatgcgggctgttcccaacccagatccaggttaggaacataatgagccccgtgatgggagtcattggctttagtttctttgtgaaggattgggccgaacggatccgtgagttcatggaaaaagagtgtccttttattaagccagaaatcaaaccgggcacacccgcgcaggaggcagagttcctcaagcgcaataaagtgtactttatgcaaagacaggacgtcttagataagaaccatgttgccgacatcgataagctgattgactatgctgcctccggggatcctacctctccagacaatatagaaagccccaacgcaccttgggtgttcgcttgcgccccagacaggtgtcccccgacgtgcatctacgtagcgggaatggccgagcttggtgcattttccattttgcaggatatgcggaatactatcatggcttcaaaaacagtgggcaccgccgaagagaagctgaaaaagaaaagtagcttctaccaatcttatctacgacgcactcagtccatggggatacagctcgaccagagaattatcctgctttacatgctggaatggggaaaggagatggtcgatcacttccatttgggcgacgatatggaccctgagctcaggggtctggctcaagccttaatcgatcagaaggtgaaagaaatttcaaaccaggagcccctgaagatctga

SEQ ID NO: 5790 - RNA, 1302 nt, synthetic construct
  misc_feature 1..1302: note = derived and/or modified CDS sequence (opt3) from PUUV(Bavaria CG 34/04)__AY954723.2__N
  source 1..1302: mol_type = other RNA
atgagcgacctgaccgatatccaggaggacattacaagacacgaacaacagctcgtggtcgccaggcagaaacttaaggatgctggcaaggcagttgagatggaccccgatgacgtgaacaaaaatactctgcaggcccggcaacagacggtatccgcgttggaagataagttagctgactacaaacgccgaatggccgatgcagtgtctcgtaagaagatggacaccaaacctacagatccaactgggatagagccggacgatcatctgaaggaaagatcaagtctaaggtatggaaacgtcctcgacgtgaatgccatcgacattgaggagcccagcggtcagaccgctgattggtacacaatcggcgtttatgtgattgggttcaccctgcctatcatacttaaagcactgtacatgttgtccactcggggacgccagacagtcaaggaaaacaaaggcaccagaatcaggtttaaggacgatacgtctttcgaggacattaatggtatccggcgcccaaagcacctctatgtgtcgatgcccactgcccaatcaaccatgaaagctgaagaactgacacctgggcgatttagaactattgtatgcggactgttcccaacccagatccaggttaggaacataatgagccccgtgatgggcgtcattggctttagtttctttgtgaaggattgggccgagcggatccgtgagttcatggagaaagaatgtccttttattaagccagagatgaaaccggggacacccgcgcaggaagcagagttcctcaagcgcaataaagtgtactttatgcaaagacaggacgtcttagataagaaccatgttgccgacatcgataagctgatcgactatgctgcctccggagatcctacctctccagacaatattgagagccccaacgcaccttgggtgttcgcttgcgccccagacaggtgtcccccgacgtgcatatacgtagcgggtatggccgaacttggcgcatttttctccatcttgcaggatatgcggaatactattatggcttcaaaaacagtggggaccgccgaggaaaagctgaaaaagaaaagtagcttctaccaatcttatctacgacgcactcagtccatgggaatccagctcgaccagagaataattctgctttacatgctggagtggggcaaggaaatggtcgatcactttcatttgggtgacgatatggaccctgagctcagggggctggctcaagccttaatcgatcagaaggtgaaagagatctcaaaccaggaacccctgaagatttga

SEQ ID NO: 5791 - RNA, 1302 nt, synthetic construct
  misc_feature 1..1302: note = derived and/or modified CDS sequence (opt3) from PUUV(Bavaria CG 41/04)__DQ016432.2__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataacttagctgactacaagcgccgaatggccgatgcagtgtctcgtaaaaagatggacaccaagcctacagatccaactggcatagaaccggacgatcatctgaaagagagatcaagtctaaggtatgggaatgtcctcgacgtgaacgccatcgacattgaggaacccagcggacagaccgctgattggtacacaatcggtgtttatgtgattggcttcaccctgcctatcatacttaaggcactgtacatgttgtccactcgggggcgccagacagtcaaagagaataagggaaccagaatcaggtttaaagacgatacgtctttcgaagacattaacggcatccggcgcccaaagcacctctatgtgtcgatgcccactgcccaatcaaccatgaaggctgaggagctgacacctggtcgatttagaactattgtatgcgggctgttcccaacccagatccaggttaggaatataatgagccccgtgatgggagtcattggctttagtttctttgtgaaagattgggccgaacggatccgtgagttcatggaaaaggagtgtccttttattaaaccagaaatgaagccgggcacacccgcgcaggaggcagagttcctcaaacgcaacaaggtgtactttatgcaaagacaggacgtcttagataaaaatcatgttgccgacatcgataagctgatcgactatgctgcctccggggatcctacctctccagacaacattgaaagccccaatgcaccttgggtgttcgcttgcgccccagacaggtgtcccccgacgtgcatatacgtagcgggaatggccgagcttggtgcatttttctccatcttgcaggatatgcggaacactattatggcttcaaagacagtgggcaccgccgaagagaaactgaagaaaaagagtagcttctaccaatcttatctacgacgcactcagtccatggggatccagctcgaccagagaataattctgctttacatgctggaatggggaaaagagatggtcgatcactttcatttgggcgacgatatggaccctgagctcaggggtctggctcaagccttaatcgatcagaaggtgaaggaaatctcaaatcaggagcccctgaaaatttga

SEQ ID NO: 5792 - RNA, 1302 nt, synthetic construct
  misc_feature 1..1302: note = derived and/or modified CDS sequence (opt3) from PUUV(Bavaria CG 9/04)__AY954722.2__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgactacaaacgccgaatggccgatgcagtgtctcgtaagaagatggacaccaaacctacagatccaactggcatagaaccggacgatcatctgaaggagagatcaagtctaaggtatgggaacgtcctcgacgtgaatgccatcgacattgaggaacccagcggacagaccgctgattggtacacaatcggtgtttatgtgattggcttcaccctgcctatcatacttaaagcactgtacatgttgtccactcgggggcgccagacagtcaaggagaacaaaggaaccagaatcaggtttaaggacgatacgtctttcgaagacattaatggcatccggcgcccaaagcacctctatgtgtcgatgcccactgcccaatcaaccatgaaagctgaggagctgacacctggtcgatttagaactattgtatgcgggctgttcccaacccagatccaggttaggaacataatgagccccgtgatgggagtcattggctttagtttctttgtgaaggattgggccgaacggatccgtgagttcatggaaaaagagtgtccttttattaagccagaaatgaaaccgggcatccccgcgcaggaggcagagttcctcaagcgcaataaagtgtactttatgcaaagacaggacgtcttagataagaaccatgttgccgacatcgataagctgattgactatgctgcctccggggatcctacatctccagacaatatagaaagccccaacgcaccttgggtgttcgcttgcgccccagacaggtgtcccccgacctgcatctacgtagcgggaatggccgagcttggtgcatttttctccattttgcaggatatgcggaatacgatcatggcttcaaaaactgtgggcacagccgaagagaagctgaaaaagaaaagtagcttctaccaatcttatctacgacgcacccagtccatggggatacagctcgaccagagaattatcctgctttacatgctggaatggggaaaggagatggtcgatcactttcatttgggcgacgatatggaccctgagctcaggggtctggctcaagccttaatcgatcagaaggtgaaagaaatttcaaaccaggagcccctgaagatctga

SEQ ID NO: 5793 - RNA, 1302 nt, synthetic construct
  misc_feature 1..1302: note = derived and/or modified CDS sequence (opt3) from PUUV(Bergsjobo/Mg25/05)__GQ339483.1__N
  source 1..1302: mol_type = other RNA
atgagcgacctggccgatatccaggacgagattaccagacacgaacaacagctcgtggctgcaaggcagaaacttaaagatgccgagcgggcggtcgaagttgaccccgatgacgtgaacaagaatacactgcaggctcgccaacagactgtatccgccttggaggataaattagcagacttcaagcgacgtatggccgatgctgtgtctagaaagaagatggacacgaagcctaccgatccaacaggcatagaaccggacgatcatctgaaagagaggtcaagtctacggtacgggaacgtcctcgacgtgaatgcaatcgacattgaggaacccagcggacagactgccgattggtataccatcggtgtttacgtgattggctttacactgcctatcatacttaaggctctgtatatgttgtccacccgcgggagacagactgtcaaagagaacaagggaacaaggatccggttcaaagacgatacctcttttgaagacattaatggcatccgccgaccaaagcacctctacgtgtcgatgcccacggcccaatcaactatgaaggcggaggagctgacccctggtagattcaggacaattgtatgcgggctgtttccaactcagatccaggttcggaacataatgagccccgtgatgggagtcattggcttctcctttttcgtgaaagattgggcagaacgtatccgcgagtttatggaaaaggagtgtcctttcattaaaccagaagtgaagccgggcacccccgcccaggaggtcgagtttctcaaaaagaataaaatctatttcatgcaaagacaggacgttttagataagaaccatgtggctgacatcgataagctgattgactacgccgcaagtggggatcctacatctccagacaatatagaaagccccaacgctccttgggtatttgcctgcgcgccagacaggtgtcccccgacctgcatctatgtggccggaatggcagagcttggtgctttcttctccattttgcaggatatgcggaatacgatcatggcctcaaaaactgtcggcacagctgaagagaagctgaaaaagaaaagtagcttttaccaatcttacctacgacgcacccagtccatggggatacagctcgaccagagaattatcctgctttatatgctggaatggggaaaggagatggtggatcacttccatttgggcgacgatatggaccctgagctcaggggtctggcccaagcattaatcgatcagaaggttaaagaaatttcaaaccaggagcccctgaagatctga

SEQ ID NO: 5794 - RNA, 1302 nt, synthetic construct
  misc_feature 1..1302: note = derived and/or modified CDS sequence (opt3) from PUUV(CG14444)__AJ277075.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggccaaagcacctctacgtgtcgatgcccactgcccagtcaaccatgaaagctgaggagctgacacctggtcgcttccgaactattgtatgcgggctgtttccaacccagatccaggttagaaacataatgagccccgtgatgggagtcattggcttctcctttttcgtgaaggattgggccgacaggatccgggaatttatggagaaagaatgtcctttcattaagccagaggtgaaaccgggcacacccgcgcaagaagcagagtttctcaagcgtaataaaatctatttcatgcagcgccaggaggtcttagataagaaccatgttgccgacatcgataagctgattgactacgctgccagtggggatcctacctctccagacaatatagaagcacccaacgctccttgggtgtttgcctgcgcgccagacagatgtcccccgacgtgcatctatgtagccggaatggcagagcttggtgctttcttcagcattttgcaagatatgaggaatactatcatggcctccaaaacagtgggcaccgctgaagagaagctgaaaaagaaatcaagtttttaccagagctacctacggcgaactcagtctatggggatacagctcgaccaacgcattatcctgctttatatgctggaatggggaaaggagatggtcgatcacttccatttgggcgacgatatggaccctgagctcagaggtctggcccaggcattaatcgatcagaaggtgaaagaaatttccaaccaggagcccctgaagatctga

SEQ ID NO: 5795 - RNA, 1302 nt, synthetic construct
  misc_feature 1..1302: note = derived and/or modified CDS sequence (opt3) from PUUV(CG14445)__AJ277076.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggccaaagcacctctacgtgtcgatgcccactgcccagtcaaccatgaaagctgaggagctgacacctggtcgcttccgaactattgtatgcgggctgtttccaacccagatccaggttagaaacataatgagccccgtgatgggagtcattggcttctcctttttcgtgaaggattgggccgacaggatccgggaatttatggagaaagaatgtcctttcattaagccagaggtgaaaccgggcacacccgcgcaagaagcagagtttctcaagcgtaatatcatctatttcatgcagcgccaggaggtcttagataaaaaccatgttgccgacattgataagctgatagactacgctgccagtggggatcctacctctccagacaatatcgaagcacccaacgctccttgggtgtttgcctgcgcgccagacagatgtcccccgacgtgcatttatgtagccggaatggcagagcttggtgctttcttcagcatcttgcaagatatgaggaatactataatggcctccaagacagtgggcaccgctgaagagaaactgaagaaaaagtcaagtttttaccagagctacctacggcgaactcagtctatggggattcagctcgaccaacgcatcatcctgctttatatgctggaatggggaaaagagatggtcgatcacttccatttgggcgacgatatggaccctgagctcagaggtctggcccaggcattaattgatcagaaggtgaaggaaatctccaaccaggagcccctgaaaatttga

SEQ ID NO: 5796 - RNA, 1302 nt, synthetic construct
  misc_feature 1..1302: note = derived and/or modified CDS sequence (opt3) from PUUV(CG1820/POR)__KT885052.1__N
  source 1..1302: mol_type = other RNA
atgagcgacctgaccgatatccaggaggaaattacaagacacgagcaacagctcgtggtcgccaggcagaaacttaaagacgctgaacgggcagttgaggtggatcccgacgatgtaaacaagtccactctgcaggcccgccaacagacggtgtctgcgttggaagacaaattagctgattacaagcgacgtatggccgacgcagtctcaagaaagaagatggataccaagcctacagacccaactggcatagagccggatgaccatctgaaagagaggagtagcctacggtatgggaatgtgctcgatgttaacgccatcgacattgaagaaccctccggacagaccgctgactggtacacaatcggtgtgtatgtcattggcttcaccatccctataatcctgaaggcactttacatgctgtctactcgcgggagacagacagtgaaagaaaataagggaaccaggattcggtttaaagatgacacgtcgttcgaggatatcaacggcattcgccgaccaaagcacttgtatgtatcaatgcccactgcccaaagcaccatgaaggctgaggaactcacacctggtagatttaggactatcgtttgcgggctgttcccaacccagatacaggtgcggaatattatgagtcccgtcatgggagtgatcggcttttccttctttgtgaaagactggcctgagaagattcgtgagttcatggagaaagaatgtccatttatcaagccggaggtcaaacccggcacccctgcccaggaggttgagttcctgaagcgcaacagagtgtactttatgacaaggcaagatgtactcgacaaaaatcatgtggcggatatcgacaagttaattgattatgcagcctctggggacccaacgagccccgatgacatagaatcccctaacgctccatgggtcttcgcctgcgcacccgaccggtgtccgcctacttgcatctacgtggctggaatggccgaactgggtgcgtttttctcaattcttcaggatatgcgaaatacaatcatggccagtaagaccgttggcactgcagaggaaaaattgaagaaaaagagctctttctaccagtcctatctgcgcagaacacaatcaatggggatacagctagaccagaggattatcctcctgtacatgcttgagtggggaaaagagatggtggatcactttcatctgggcgacgatatggaccccgaattgcggggtctcgctcagagcctgatcgatcaaaaggtcaaggagattagtaaccaggaaccattaaaaatctga

SEQ ID NO: 5797 - RNA, 1302 nt, synthetic construct
  misc_feature 1..1302: note = derived and/or modified CDS sequence (opt3) from PUUV(Couvin/59Cg/97)__AJ277034.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggccaaagcacctctacgtgtcgatgcccactgcccagtcaaccatgaaagctgaggagctgacacctggtcgcttccgaactattgtatgcgggctgtttccaacccagatccaggttagaaacataatgagccccgtgatgggagtcattggcttctcctttttcgtgaaggattgggccgacaggatccgggaatttatggagaaagaatgtcctttcattaagccagaggtgaaaccgggcacacccgcgcaagaagcagagtttctcaagcgtaataaaatctatttcatgcagcgccaggatgtcttagacaagaaccatgttgccgatatcgacaagctgattgattacgctgccagtggggaccctacctctccagacaatatagaggcacccaacgctccttgggtgtttgcctgcgcgccagatagatgtcccccgacgtgcatctatgtagccggaatggcagaacttggtgctttcttcagcattttgcaagacatgaggaatactatcatggcctccaaaacagtgggcaccgctgaggaaaagctgaaaaagaaatcaagtttttaccagagctacctacggcgaactcagtctatggggatacagctcgatcaacgcattatcctgctttatatgctggagtggggaaaggaaatggtcgaccacttccatttgggcgatgacatggatcctgagctcagaggtctggcccaggcattaatcgaccagaaggtgaaagagatttccaaccaggaacccctgaagatctga

SEQ ID NO: 5798 - RNA, 1302 nt, synthetic construct
  misc_feature 1..1302: note = derived and/or modified CDS sequence (opt3) from PUUV(Evo/12Cg/93)__Z30702.1__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgactacaagcgacgtatggccgatgcagtctctagaaagaagatggacaccaagcctacagatccaactggcatagaaccggacgatcatctgaaagagaggtcaagtctacggtatgggaacgtgctcgacgttaatgccatcgacattgaggaacccagcggacagaccgctgattggtacacaatcggtgtgtatgtcattggcttcaccatccctataatcctgaaggcactttacatgctgtccactcgcgggagacagacagtgaaagagaacaagggaaccaggattcggtttaaagacgatacgtctttcgaagacatcaatggcattcgccgaccaaagcacttgtatgtatcgatgcccactgcccaatcaaccatgaaggctgaggagctcacacctggtagatttaggactatcgtttgcgggctgttcccaacccagatacaggtgcggaacattatgagccccgtcatgggagtgatcggctttagtttctttgtgaaagattggcctgaacgtattcgcgagttcatggaaaaggagtgtccatttatcaaaccggaaatcaagcccggcacccctgcccaggagatggagatgctgaaaagaaataagatttacttcatgcaaaggcaggacgtcctcgataaaaaccatgttgcggacatagataagttaatcgactatgcagcctccggggatccaacatctcccgacaatattgacagccctaacgctccatgggtgtttgcctgcgcacccgatcggtgtccgcctacgtgcatctacgtagctggaatggccgaactgggtgcgttcttttccatacttcaggacatgcgaaatactattatggcctcaaagacagtgggcaccgcagaggaaaaattgcgcaagaaaagtagcttctaccaatcttatctgagaaggactcagtccatggggatccagctagatcagcggatcattctcctgttcatgcttgagtggggaaaggaaatggtcgaccactttcatctgggcgatgacatggatcccgagttgcgcggtctcgctcaagccctgatcgaccagaaagtgaaggagatttcaaaccaggaaccattaaagatatga

SEQ ID NO: 5799 - RNA, 1302 nt, synthetic construct
  misc_feature 1..1302: note = derived and/or modified CDS sequence (opt3) from PUUV(Evo/14Cg/93)__Z30704.1__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctaactacaagcgacgtatggccgacgcagtctctagaaagaagatggataccaagcctacagacccaactggcatagaaccggatgaccatctgaaagagaggtcaagtctacggtatgggaatgtgctcgatgttaacgccatcgacattgaggaacccagcggacagaccgctgactggtacacaatcggtgtgtatgtcattggcttcaccatccctataatcctgaaggcactttacatgctgtccactcgcgggagacagacagtgaaagagaataagggaaccaggattcggtttaaagatgacacgtctttcgaagatatcaacggcattcgccgaccaaagcacttgtatgtatcgatgcccactgcccaatcaaccatgaaggctgaggagctcacacctggtagatttaggactatcgtttgcgggctgttcccaacccagatacaggtgcggaatattatgagccccgtcatgggagtgatcggctttagtttctttgtgaaagactggcctgaacgtattcgcgagttcatggaaaaggagtgtccatttatcaaaccggaaatcaagcccggcacccctgcccaggagatggagatgctgaaaagaaacaagatttacttcatgcaaaggcaggatgtcctcgacaaaaatcatgttgcggatatagacaagttaatcgattatgcagcctccgggggaccaacatctcccgacaacattgatagccctaatgctccatgggtgtttgcctgcgcacccgaccggtgtccgcctacgtgcatctacgtagctggtatggccgaactgggcgcgttcttttccatacttcaggacatgcgaaacactattatggcctcaaagacagtggggaccgcagaggaaaaattgaagaaaaagagtagcttctaccaatcttatctgcgcagaactcagtccatgggaatccagctagatcagaggatcattctcctgttcatgcttgagtggggcaaagaaatggtcgaccactttcatctgggtgatgacatggatcccgagttgcgggggctcgctcaagccctgatcgaccagaaggtgaaggagatttcaaatcaggaaccattaaaaatatga

SEQ ID NO: 5800 - RNA, 1302 nt, synthetic construct
  misc_feature 1..1302: note = derived and/or modified CDS sequence (opt3) from PUUV(Evo/15Cg/93)__Z30705.1__N
  source 1..1302: mol_type = other RNA
atgagcgacctgaccgatatccaggaggacattacaagacacgaacaacagctcgtggtcgccaggcagggccttaaggatgctgagcgggcagttgaagtggaccccgatgacgtaaacaaaaatgccctgcaggcgcgccaacagactgtgtccgctttggaggataagttagccgactacaaacgacgtatggcagatgccgtctctagaaagaaaatggacacgaagcctaccgatccaacagggatagaaccggacgatcatctgaaggagaggtcaagtctacggtatggaaacgtgttcgacgttaatgctatcgacattgaggaacccagcggtcagactgcagattggtacaccatcggcgtgtatgtcattgggtttacaatccctataatcctcaaagccctgtacatgctttccacccgcggaagacagactgtgaaggagaacaaaggcacaaggattcggttcaaggacgatacctcttttgaagacatcaatggtattcgccgaccaaaacacctgtatgtatcgatgcccacggctcaatcaactatgaaggccgaggagttgacccctgggagattcaggacaatcgtttgcggactctttccaactcagatacaggtgcggaacattatgagccccgtcatgggcgtgatcggcttctcctttttcgtgaaggattggcctgaacgtattcgcgagtttatggaaaaagagtgtccattcatcaagccggaaatcaaacccgggacccctgcgcaggagatggagatgctgaagagaaataaaatttactttatgcaaaggcaggacgtcctggataagaaccatgttgcagacatagataaactcatcgactatgccgctagtggagatccaacatctcccgacaatattgacagccctaacgccccatgggtgttcgcatgcgctcccgatcggtgtccgcctacctgcatctacgtagccggtatggcggaattaggcgcctttttctccatactgcaggacatgcgaaatacgattatggcatcaaagactgtggggacagctgaggaaaaacttaagaagaaaagtagcttctaccaatcttatttgcgcagaacccagtccatgggaatccagctggatcagaggatcattctactctttatgctggagtggggcaaggaaatggtcgaccacttccatcttggtgatgacatggatcccgagctgcgggggttggcccaagctctcatcgaccagaaagtgaaggagatttcaaaccaggaaccactgaagatatga

SEQ ID NO: 5801 - RNA, 1302 nt, synthetic construct
  misc_feature 1..1302: note = derived and/or modified CDS sequence (opt3) from PUUV(Faboviken/Mg26/05)__GQ339484.1__N
  source 1..1302: mol_type = other RNA
atgagcgacctggccgatatccaggacgagattaccagacacgaacaacagctcgtggctgcaaggcagaaacttaaagatgccgagcgggcggtcgaaatggaccccgatgacgttaacaagaatacactgcaggctcgccaacagactgtgtccgccttggaggataaattagcagacttcaagcgacgtatggccgatgctgtatctagaaagaagatggacacgaagcctaccgatccaacaggcatagaaccggacgatcatctgaaagagatctcaagtctaaggtacgggaacgtgctcgacgtcaatgcaattgacatcgaggaacccagcggacagactgccgattggtataccattggtgtgtacgttatcggctttacactgcctataatccttaaggctctgtatatgttgtccacccgggggcgccagactgtgaaagagaacaagggaacaagaattaggttcaaagacgatacctcttttgaagacatcaatggcattcggcgcccaaagcacctctacgtctcgatgcccacggcccaatcaactatgaaggcggaggagctgacccctggtcgattcagaacaatcgtgtgcgggctgtttccaactcagatacaggtaaggaacattatgagccccgttatgggagtgatcggcttctcctttttcgtcaaagattgggcagaacggattcgtgagtttatggaaaaggagtgtcctttcatcaaaccagaagtgaagccgggcacccccgcccaggaggtggagtttctcaaaaagaataaaatctatttcatgcaacgccaggacgtcttagataagaaccatgttgctgacattgataagctgatagactacgccgcaagtggggatcctacatctccagacaatatcgaaagccccaacgctccttgggtgtttgcctgcgcgccagacagatgtcccccgacctgcatttatgtagccggaatggcagagcttggtgctttcttctccatcttgcaggatatgaggaatacgataatggcctcaaaaactgtgggcacagctgaagagaagctgaaaaagaaaagtagcttttaccaatcttacctacggcgaacccagtccatggggattcagctcgaccagcgcatcatcctgctttatatgctggaatggggaaaggagatggtcgatcacttccatttgggcgacgatatggaccctgagctcagaggtctggcccaagcattaattgatcagaaggtgaaagaaatctcaaaccaggagcccctgaagatttga

SEQ ID NO: 5802 - RNA, 1302 nt, synthetic construct
  misc_feature 1..1302: note = derived and/or modified CDS sequence (opt3) from PUUV(Fyn)__AJ238791.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatgcgggctgtttccaacccagatccaggttaggaacataatgagccccgtgatgggagtcattggcttctcctttttcgtgaaggattgggccgaacggatccgtgagtttatggaaaaagagtgtcctttcattaagccagaactcaaaccgggcacaaatgcgcaggaggcagagtttttaaagaaaaaccgcgtgtatttcctgaatagacaagacgtccttgataagaaccatgttgccgacatcgataagttgatcgactacgctgccagtggggatcccacctctcctgacaatattgaagcaccaaacgctccctgggtgtttagctgcgcccctgacaggtgtccacccacgtgcatatatgtagcgggaatggccgagctgggtgcattcttctccatcctacaggatatgcggaatactattatggcttcaaaaacagtgggcaccgccgaagagaagctcaaaaagaaaagtagcttttaccagtcttacctgcgacgcactcaatccatggggatccagcttgaccagagaataattctgttgtatatgctcgaatggggaaaggagatggtcgatcacttccatctgggcgacgatatggacccggagttaaggggtctggctcaggccctcatcgatcaaaaggtgaaagaaatctcaaaccaggagcctcttaagatttga

SEQ ID NO: 5803 - RNA, 1302 nt, synthetic construct
  misc_feature 1..1302: note = derived and/or modified CDS sequence (opt3) from PUUV(Fyn131)__AJ278093.1__N
  source 1..1302: mol_type = other RNA
atgagcgacctgaccgatatccaggaggacattacaagacacgaacaacagctcgtggtcgccaggcagaaacttaaagatgctgagaaggcagttgaaatggaccccgatgacgtgaacaaaaatactctggaggcccggcagcaaacggtatccgcgttggaagataagttagctgacttcaaacgccgaatgaccgatgccgtgtctcgtaagaagatggacacaaaacctactgatccaaccggcatagagccggacgatcatctgaaggagagatcaagtctaaggtacgggaacgtcctcgacgtgaatgcaatcgacattgaggaacccagcggacagacagccgattggtataccatcggtgtttacgtgattggctttactctgcctatcatacttaaagctctgtatatgttgtccacacgggggcgccagaccgtcaaggaaaacaaaggaacgagaatcaggttcaaggacgatacttcttttgaggacattaatggcatccggcgcccaaagcacctctacgtgtcgatgcccaccgcaccttcaacaatgaaagccgaggaactgactccaggtcgattcagaaccattgtatgcgggctgtttcccacacagatccaagttaggaacataatgagccctgtgatgggagtcattggcagttccttctttgtgaaggattgggctgaccggatccgtgagttcatggaaaaagagtgtccatttgtgaagccggaactcaaacccggcaccaatgcccaggaggcggagttcttaaagaaaaaccgcgtctattttatgaatagacaggatgttctggacaagaaccatgtggcagatattgacaaacttatcgattacgccgcttctggggaccctacgtgcccagacaatatcgaagcccccaacgcaccttggggattcgcttgtgccccacacaggtgtcccccgacttgcatttatgtagcgggtatggccgagttgggcgcatttttcagcatactgcaggatatgcggaatacaatcatggcttccaagaccgtggggactgccgaagagaagctaaagaagaaatcaagtttctaccaaagctacctccgacgcacacagtctatgggcattcagctggaccaaagaatcatacttctgtatatgttggaatggggaagggagatggtcgatcattttcacctcggtgacgatatggaccctgagctgcgggggttagctcaggccctgattaaccagaaggtgaaggaaatctccaatcaggagcccctcaaaatctga

SEQ ID NO: 5804 - RNA, 1302 nt, synthetic construct
  misc_feature 1..1302: note = derived and/or modified CDS sequence (opt3) from PUUV(Fyn47)__AJ278092.1__N
  source 1..1302: mol_type = other RNA
atgagcgacctgaccgatatccaggaggacattacaagacacgaacaacagctcgtggtcgccaggcagaaacttaaagatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgccccttcaaccatgaaagctgaggagctgacaccaggtcgattcagaactattgtatgcgggctgtttcccacccaaatccaggttaggaagataatgagccctgtgatgggagtcattggcttctcctttttcgtgaaagattgggtggaacggatccgtgagtttatggaaaaggagtgtccattcgtcaaaccggaactcaagcccggcacaaacgcccaggaggcggagtttttaaagaagaatcgcgtttatttcatgaacagacaggacgtgctggataagaatcatgtagcagacattgataaacttatcgactacgccgctagtggggatcctacctctccagacaacatcgaagcccccaatgcaccttgggtgtttgcttgcgccccacacaggtgtcccccgacgtgcatttatgtcgcgggaatggccgagttgggtgcattcttcagcatactgcaagacatgcggaacgctatcatggcctccaagactgtgggcacagctgaagagaaactaaagaaaaagtcaagtttttaccagagctacctccgacgcacccagtctgttgggattcaactggatcagagaatcatacttctgtatatgttggaatggggaagggagatggtggaccatttccacctcggcgatgacatggatcctgagctgcggggtttagcccaggcactgattgaccagaaggtcaaagaaatctccaatcaagagcccctcaagatctga

SEQ ID NO: 5805 - RNA, 1302 nt, synthetic construct
  misc_feature 1..1302: note = derived and/or modified CDS sequence (opt3) from PUUV(Gomselga)__AJ238790.1__N
  source 1..1302: mol_type = other RNA
atgagcgacctgaccgatatccaggaggacattacaagacacgaacaacagctcgtggtcgccaggcagaaacttaaggatgctgagcgggcagttgaagtggaccccgatgacgtaaacaagaatactctgcaggcccgccaacagacggtgtccgcgttggaggataaattagctgactacaagcgaaaaatggccgatgcagtctctcgtaagaagatggacaccaaacctacagatccaactggcatagaaccggacgatcatctgaaggagagatcaagtctaaggtatgggaacgtgctcgacgttaatgccatcgacattgaggatcccagcggacagaccgctgactggtacacaatcggtgtgtatgtcattggcttcaccctgcctatcatacttaaagcactgtacatgttgtccactcgggggcgccagacagtgaaggaaaacaaaggaaccagaatcaggtttaaggatgacacgtctttcgaggaaattaatggcatccggcgcccaaagcacctctatgtatcgatgcccactgcccaatcaaccatgaaagctgaggagctgacacctggtcgatttagaactattgtttgcgggctgttcccaacccagatccaggtgaggaacatagtcagccccgtgatgggagtgattggctttagtttctttgtcaaggattggtcccagcggatcacagagttcatggaaaaagaatgtccttttattaagccagaggttaaaccgggcacccccgcccaagaaatcgagatgttcaagcgtaataaaatctactttatgcagcgccaggacgtgctcgataagaaccatgtagcggacattgataagtctatagactatgcagccagcgaggatcctacgtccccagacaatatcgactcacccaacgctccttgggtgttcgcctgcgcaccagatagatgtcccccgacttgcatttacgtcgctgggatggccgaattaggagcgtttttcagtatcctgcaagacatgaggaatacaataatggccagcaaaaccgtgggtactgcagaggaaaaacttaagaagaaatcttccttctaccagtcatatttgcggcgaacacagagcatgggcattcagctggatcaacgcatcatcctactctttatgctggagtgggggaaggaaatggttgaccacttccatcttggagatgacatggatcctgagctgagaggcttggctcaggccctcattgaccagaaggtgaaagagatcagtaaccaggaacccctgaagatttga

SEQ ID NO: 5806 - RNA, 1302 nt, synthetic construct
  misc_feature 1..1302: note = derived and/or modified CDS sequence (opt3) from PUUV(Gyttjea/Mg19/05)__GQ339480.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggccaaagcacctctacgtgtcgatgcccactgcccagtcaaccatgaaagctgaggagctgacacctggtcgcttccgaactattgtatgcgggctgtttccaacccagatccaggttagaaacataatgagccccgtgatgggagtcattggcttcgcctttttcgtgaagggctgggcggataggatccgggaatttatggagaaagaatgtcctttcattaagccagaggtgaaaccggggacacccacccaagaaatcgagtttctcaagaaaaataaggtctatttcttagaccgtcagacggttctggataagaaccatgtggcagacatcgataaacttattgactacgccgctagtggagatcctacttccccagacaatatagagtctcccaacgccccttgggtatttgcatgcgctccagaccgctgtcccccgacatgcatctatgtggccggtatggcggaattgggcgccttcttcagcattctgcaggatatgagaaataccatcatggcatccaagactgtcgggacagctgaggaaaaactaaagaaaaagtcaagtttttaccaaagctacctcaggcggacccagtctatgggaatacagctggaccagcgaattatccttctgttcatgttggagtggggcaaggaaatggtggatcactttcatctcggtgacgatatggaccctgagctgcgcgggttagcccaagctctgatcgatcagaaagttaaggagatttccaaccaggaacccctcaaaatctga

SEQ ID NO: 5807 - RNA, 1302 nt, synthetic construct
  misc_feature 1..1302: note = derived and/or modified CDS sequence (opt3) from PUUV(Karhumaki)__AJ238788.1__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgactacaagcgaaaaatggccgatgcagtctctcgtaagaagatggacaccaaacctacagatccaactggcatgaagccggacgtgcatctgaaagaaagatcaagtctagagtatgggaacgttctcgatgtgaatgccatagacatcgaggaacccagcggacagaccgctgactggtacacaattggtgtctatgtgatcggcttcaccctgcctattatccttaaggcactgtacatgttgtccactagggggcggcagacagtaaaagagaacaagggaacccgcataagatttaaggatgacacgtctttcgaagatatcaatggcattaggcggccaaaacacctctatgtttcgatgcccactgcccaatcaaccatgaaggctgaggagctgacacctggtcgctttcgaactatcgtgtgcgggctgttcccaacccagattcaggtcagaaacatcatgagccccgtgatgggagtgataggctttagtttctttgtcaaagactggtccgaaaggattcgggagttcatggaaaaggagtgtccttttatcaaaccagaagttaagccgggcacacccgcccaggagattgagatgctccgtcgcaataaaatctacttcatgcaaagacaggatgtgttagacaagaaccatgtagcggatatcgacaagctgattgatcttgcagcctctggggaccctaccagcccagataatatagactcccccaacgctccttgggtgtttgcctgcgcaccagtcaggtgtcccccgacgtgcatctatgtggctggaatggccgaattgggtgcgttcttttcaattctgcaggacatgcggaatactatcatggccagtaaaacagttggcaccgcagaggaaaagctaaagaagaaaagctctttctaccaatcctacctccgacgcactcagtcaatggggatacagctggatcagagaattatccttctgttcatgttggagtggggaaaggaaatggtggaccactttcatctcggcgatgacatggatcctgagctgaggggtttagctcaagccctgatcgaccagaaggtcaaagagattagcaaccaggaacccctcaagatctga

SEQ ID NO: 5808 - RNA, 1302 nt, synthetic construct
  misc_feature 1..1302: note = derived and/or modified CDS sequence (opt3) from PUUV(Kolodozero)__AJ238789.1__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgactacaagcgacgtatggccgatgcagtctctagaaagaagatggacaccaagcctacagatccaactggcatagaaccggacgatcatctgaaagagaggtcaagtctacggtatgggaacgtgctcgacgttaatgccatcgacattgaggaacccagcggacagaccgctgattggtacacaatcggtgtgtatgtcattggcttcaccctgcctatcatacttaaggcactgtacatgttgtccactcgcgggagacagacagtgaaagagaacaagggaaccaggatccggtttaaagacgatacgtctttcgaagacattaatggcatccgccgaccaaagcacctctatgtatcgatgcccactgcccaatcaaccatgaaggctgaggagctgacacctggtagatttaggactattgtttgcgggctgatcccaacccagatacaggtgcggaacattatgagccccgtcatgggagtgatcggcttctcctttttcgtgaaagattggagtgaacgtattcgcgagtttatggaaaaggagtgtcctttcatcaaaccagaagtcaagccgggcacatctgcccaggagatcgagatgctcaaaagaaataagatttactttatgcaaaggcaggacgttttagataaaaaccatgtggcggacatagataagctgatcgactatgcagccagcggggatcccacctcccctgacaatattgactcaccaaacgctccctgggtattcgcctgcgcacctgatcggtgtccacccacgtgcatctacgtggctggaatggccgaacttggtgcgtttttcagtatattgcaggacatgcgaaatactattatggccagcaagacagtcggcaccgcagaggaaaaactgaagaaaaagtcttccttttaccaatcatatctacgcagaactcagagcatggggatcccgctcgatcagaggatcattctgcttttcatgctggagtggggacaggaaatggtggaccacttccatttgggcgatgacatggatcctgagctccggggtctggctcaagccttaatcgaccagaaagttaaggagattagtaaccaggaacccctgaagatatga

SEQ ID NO: 5809 - RNA, 1302 nt, synthetic construct
  misc_feature 1..1302: note = derived and/or modified CDS sequence (opt3) from PUUV(Kuhmo/X11)__GU808825.1__N
  source 1..1302: mol_type = other RNA
atgagcgacctgaccgatatccaggaggacattacaagacacgaacaacagctcgtggtcgccaggcagaaacttaaagatgctgagcgggcagttggcgtggaccccgatgacgtaaacaagaatactctgcaggcccgccaacagacggtgtccgcgttggaagataaattagctgactacaagcgacgtatggccgatgcagtctctagaaagaagatggacaccaagcctacagatccaactgggatagagccggacgatcatctgaaagaaaggtcaagtctacggtatggaaacgtgctcgacgttaatgccatcgacattgaggagcccagcggtcagaccgctgattggtacacaatcggcgtgtatgtcattgggttcaccctgcctatcatacttaaggcactgtacatgttgtccactcgcggaagacagacagtgaaagaaaacaagggcaccaggatccggtttaaagacgatacgtctttcgaggacattaatggtatccgccgaccaaagcacctctatgtatcgatgcccactgcccaatcaaccatgaaggctgaagaactgacacctgggagatttaggactattgtttgcggactgttcccaacccagatccaggtgcggaacataatgagccccgtcatgggcgtgattggctttagtttctttgtgaaagattggtccgagcgtatccgcgagttcatggagaaggaatgtccttttattaaaccagaggtcaagccggggacacccgcccaggaaatcgagatgctcaaaagaaataggatctacttcatgcaacggcaggacgttttagataagaaccatgtggcggacattgataaactgatagactatgcagcctctggagatcctaccagcccagacaatatcgactcccccaacgctccttgggtatttgcctgcgcaccagatcgatgtcccccgacgtgcatttacgtggctggtatggccgagcttggcgcgttcttttcaatcttgcaggacatgcgcaatactataatggccagtaagacagtcgggaccagcgaagagaagctgaaaaagaaatcttccttctaccaatcatatctaagaaggactcagagcatgggcattcagctcgatcagcggatcatcctgcttttcatgctggaatggggaaaggagatggtggaccactttcatttgggtgatgacatggatcctgaactccgcgggctggcacaggctttaattgaccaaaaagttaaggagatcagtaaccaggagcccctgaagatttga

SEQ ID NO: 5810 - RNA, 1302 nt, synthetic construct
  misc_feature 1..1302: note = derived and/or modified CDS sequence (opt3) from PUUV(Kuhmo/X5)__GU808824.1__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgactacaagcgacgtatggccgatgcagtctctagaaagaagatggacaccaagcctacagatccaactggcatagaaccggacgatcatctgaaagagaggtcaagtctacggtatgggaacgtgctcgacgttaatgccatcgacattgaggaacccagcggacagaccgctgattggtacacaatcggtgtgtatgtcattggcttcaccctgcctatcatacttaaggcactgtacatgttgtccactcgcgggagacagacagtgaaagagaacaagggaaccaggatccggtttaaagacgatacgtctttcgaagacattaatggcatccgccgaccaaagcacctctatgtatcgatgcccactgcccaatcaaccatgaaggctgaggagctgacacctggtagatttaggactattgtttgcgggctgttcccaacccagatccaggtgcggaacataatgagccccgtcatgggagtgattggctttagtttctttgtgaaagattggtccgaacgtatccgcgagttcatggaaaaggagtgtccttttattaaaccagaagtcaagccgggcacacccgcccaggagatcgagatgctcaaaagaaataggatctacttcatgcaacggcaggacgttttagataagaaccatgtggcggacattgataaactgatagactatgcagcctctggggatcctaccagcccagacaatatcgactcccccaacgctccttgggtatttgcctgcgcaccagatcgatgtcccccgacgtgcatttacgtggctggaatggccgaacttggtgcgttcttttcaatcttgcaggacatgcgcaatactataatggccagtaagacagtcggcaccgcagaggaaaagctgaaaaagaaaagctctttctaccaatcctatctaagaaggactcagtcaatggggattcagctcgatcagcggatcatcctgcttttcatgctggagtggggaaaggaaatggtggaccactttcatttgggcgatgacatggatcctgagctccgcggtctggctcaagccttaattgaccagaaagttaaggagatcagcaaccaggaacccctgaagatttga

SEQ ID NO: 5811 - RNA, 1302 nt, synthetic construct
  misc_feature 1..1302: note = derived and/or modified CDS sequence (opt3) from PUUV(Ljustrask/Mg20/05)__GQ339481.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggccaaagcacctctacgtgtcgatgcccactgcccagtcaaccatgaaagctgaggagctgacacctggtcgcttccgaactattgtatgcgggctgtttccaacccagatccaggttagaaacataatgagccccgtgatgggagtcattggcttcgcctttttcgtgaagggctgggcggataggatccgggaatttatggagaaagaatgtcctttcattaagccagaggtgaaaccggggacacccacccaagaaatcgagtttctcaagaaaaataaggtctatttcttagaccgtcagaacgttctggataagaatcatgtggcagacatcgataaacttattgactacgccgctagtggagatcctacgtccccagacaacatagagtctcccaatgccccttgggtatttgcatgcgctccagaccgctgtcccccgacttgcatctatgtggccggtatggcggaattgggcgccttcttcagcattctgcaggatatgagaaacacaatcatggcatccaagaccgtcgggactgctgaggaaaaactaaagaaaaagtcaagtttttaccaaagctacctcaggcggacacagtctatgggaatacagctggaccagcgaattatccttctgttcatgttggagtggggcaaggaaatggtggatcactttcatctcggtgacgatatggaccctgagctgcgcgggttagcccaagctctgatcgatcagaaagttaaggagatttccaatcaggaacccctcaaaatctga

SEQ ID NO: 5812 - RNA, 1302 nt, synthetic construct
  misc_feature 1..1302: note = derived and/or modified CDS sequence (opt3) from PUUV(Mangelbo/Mg1/05)__GQ339485.1__N
  source 1..1302: mol_type = other RNA
atgagcgacctgaccgatatccaggacgagattacaagacacgaacaacagctcgtggccgctaggcagaaacttaaagatgcagagcgggccgtcgaaatggaccccgatgacgttaacaagaatactctgcaggcgcgccaacagacggtgtccgctttggaggataaattagccgacttcaagcgacgtatggcagatgccgtatctagaaagaagatggacaccaagcctacagatccaactggcatagaaccggacgatcatctgaaagagaggtcaagtctacggtacggggacgtgctcgacgtcaacgctatcgatattgaggaacccagcggacagaccgcagactggtatacaatcggtgtgtacgttattggctttaccctgcctatcatacttaaggccctgtatatgttgtccactcgcgggagacagacagtgaaagagaataagggaaccaggatccggttcaaagatgacacgtcttttgaagatattaacggcatccgccgaccaaagcacctctacgtctcgatgcccactgctcaatcaaccatgaaggccgaggagctgacacctggtagattcaggactattgtgtgcgggctgtttccaacccagatccaggtacggaatataatgagccccgttatgggagtgattggcttctcctttttcgtcaaagactgggcggaacgtatccgcgagtttatggataaggaatgtcctttcattaaaccagaggtgaagccgggcacacccgcacaggaaatcgagtttctcaaaaagaacaaaatctatttcatgcaaagacaggacgtgttagataagaatcatgtcgccgacattgataagctgatagactacgctgccagtggggaccctacctctccagataacatcgagagccccaatgcaccttgggtttttgcttgcgccccagacaggtgtcccccgacgtgcatttatgtggcgggaatggccgaacttggtgcattcttctccatcttgcaggatatgcggaacactataatggcttcaaaaacagtaggcaccgccgaggaaaagctgaaaaagaaaagtagcttttaccaatcttacctacgacgcactcagtccatggggattcagctcgaccagagaatcatcctgctttatatgctggagtggggaaaggaaatggtggatcacttccatttgggcgacgatatggaccctgagctcaggggtctgacacaggctttaattgatcaaaaggtcaaagagatctcaaatcccgaaccactgaagatttga

SEQ ID NO: 5813 - RNA, 1302 nt, synthetic construct
  misc_feature 1..1302: note = derived and/or modified CDS sequence (opt3) from PUUV(Momignies/55Cg/96)__AJ277033.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggtcgaagcacctctacgtgtcaatgccaactgcccagagcaccatgaaagctgaggagctgacacccggtcgcttccgaactattgtatgcgggctgtttcctacccagatccaggttagaaacataatgagtccagtgatgggagtcattggcttctcctttttcgtgaaggattgggccgacaggatccgggaatttatggagaaagaatgtcccttcattaagcctgaggtgaaaccaggcacaccggcgcaagaagcagagtttctcaagcgtaataaaatctatttcatgcagcgccaggatgtcttagacaagaaccatgttgccgatatcgacaagctgattgattacgctgcctctggggaccccaccagccctgacaatatagaggcaccaaacgctccctgggtgtttgcctgcgcgcctgatagatgtccacccacgtgcatctatgtagccggaatggcagaacttggtgctttcttctccattttgcaagacatgaggaatactatcatggcctcaaaaacagtgggcaccgctgaggaaaagctgaaaaagaaaagtagcttttaccagtcttacctacggcgaactcagtccatggggatacagctcgatcaacgcattatcctgctttatatgctggagtggggaaaggaaatggtcgaccacttccatttgtcagatgacatggatccggagctcagaggcctggcccaggcattaatcgaccagaaggtgaaagagattagcaaccaggaacctctgaagatctga

SEQ ID NO: 5814 - RNA, 1302 nt, synthetic construct
  misc_feature 1..1302: note = derived and/or modified CDS sequence (opt3) from PUUV(Montbliart/23Cg/96)__AJ277031.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggccaaagcacctctacgtgtcgatgcccactgcccagtcaaccatgaaagctgaggagctgacacctggtcgcttccgaactattgtatgcgggctgtttccaacccagatccaggttagaaacataatgagccccgtgatgggagtcattggcttctcctttttcgtgaaggattgggccgacaggatccgggaatttatggagaaagaatgtcctttcattaagccagaggtgaaaccgggcacacccgcgcaagaagcagagtttctccgtcgcaataagatctatttcatgcagagacaggaggtcttagataaaaaccatgttgccgacatcgataagctgattgactacgctgccagtggggatcctacctctccagacaatatagaagcacccaacgctccttgggtgtttgcctgcgcgccagacaggtgtcccccgacgtgcatctatattgccggaatggcagagcttggtgctttcttcagcatcttgcaagatatgcggaatactataatggcctccaagacagtaggcaccgctgaagagaaactgaagaaaaagtcaagtttttaccagagctacctacgacgcactcagtctatggggattcagctcgaccaaagaatcatcctgctttatatgctggaatggggaaaagagatggtggatcacttccatttgggcgacgatatggaccctgagctcaggggtctggcccaggcattaattgatcagaaggtcaaggaaatctccaaccaggagcccctgaaaatttga

SEQ ID NO: 5815 - RNA, 1302 nt, synthetic construct
  misc_feature 1..1302: note = derived and/or modified CDS sequence (opt3) from PUUV(MuEb10Karlstadt/10)__JN696373.1__N
  source 1..1302: mol_type = other RNA
atgagcgacctgaccgatatccaggaggacattacaagacacgaacaacagctcgtggtcgccaggcagaagttaaaagatgctgagaaggcagttgaaatggaccccgatgacgtgaacaaaaatactctgcaggcccggcaacagacggtatccgcgttggaggataagttagctgactacaaacgccgaatggccgatgcagtgtctcgtaagaagatggacaccaaacctacagatccaactggcatagaaccggacgatcatctgaaggagagatcaagtctaaggtatgggaacgtcctcgacgtgaatgccatcgacattgaggaacccagcggacagaccgctgattggtacacaatcggtgtttatgtgattggcttcaccctgcctatcatacttaaagcactgtacatgttgtccactcgggggcgccagacagtcaaggagaacaaaggaaccagaatcaggtttaaggacgatacgtctttcgaagacattaatggcatccggcgcccaaagcacctctatgtgtcgatgcccactgcccaatcaaccatgaaagctgaggagctgacacctggtcgatttagaactattgtatgcgggctgttcccaacccagatccaggttaggaacataatgagccccgtgatgggagtcattggctttagtttctttgtgaaggattgggccgaacggatccgtgagttcatggaaaaagagtgtccttttattaagccagaaatcaaaccgggcacacccgtgcaggaggcggagttcctcaagcgcaataaagtctactttatgcaaagacaggaagttttagacaagaaccatgtggcagatatcgacaagctgattgattatgccgcttccggggaccctacctctccagataatatagagagccccaacgccccttgggtattcgcatgcgctccagacaggtgtcccccgacgtgcatctacgtggccggaatggcggaacttggtgcctttttctccattttgcaggacatgcggaatactatcatggcatcaaaaacagtcggcaccgctgaggaaaagctgaaaaagaaaagtagcttctaccaatcttatctacgacgcactcagtccatggggatacagctcgatcagagaattatcctgctttacatgctggagtggggaaaggagatggtggaccactttcatttgggcgatgacatggatcctgaactcaggggtctggcccaagctcttatcgaccagaaggttaaagagatttcaaaccaggaacccctgaagatctga

SEQ ID NO: 5816 - RNA, 1302 nt, synthetic construct
  misc_feature 1..1302: note = derived and/or modified CDS sequence (opt3) from PUUV(MuEb12Lackenberg/10)__JN696374.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgactacaaacgccgaatggccgatgcagtgtctcgtaagaagatggacaccaaacctacagatccaactggcatagaaccggacgatcatctgaaggagagatcaagtctaaggtatgggaacgtcctcgacgtgaatgccatcgacattgaggaacccagcggacagaccgctgattggtacacaatcggtgtttatgtgattggcttcaccctgcctatcatacttaaagcactgtacatgttgtccactcgggggcgccagacagtcaaggagaacaaaggaaccagaatcaggtttaaggacgatacgtctttcgaagacattaatggcatccggcgcccaaagcacctctatgtgtcgatgcccactgcccaatcaaccatgaaagctgaggagctgacacctggtcgatttagaactattgtatgcgggctgttcccaacccagatccaggttaggaacataatgagccccgtgatgggagtcattggctttagtttctttgtgaaggattgggccgaacggatccgtgagttcatggaaaaagagtgtccttttattaagccagaaatgaaaccgggcacacccgcgcaggaggcagagttcctcaagcgcaataaagtgtactttatgcaaagacaggacgtcttagataagaaccatgttgccgacatcgataagctgatcgactatgctgcctccggggatcctacctctccagacaatattgaaagccccaacgcaccttgggtgttcgcttgcgccccagacaggtgtcccccgacgtgcatatacgtagcgggaatggccgagcttggtgcatttttctccatcttgcaggatatgcggaatactattatggcttcaaaaacagtgggcaccgccgaagagaagctgaaaaagaaaagtagcttctaccaatcttatctacgacgcactcagtccatggggatccagctcgaccagagaataattctgctttacatgctggaatggggaaaggagatggtcgatcactttcatttgggcgacgatatggaccctgagctcaggggtctggctcaagccttaatcgatcagaaggtgaaagaaatctcaaaccaggagcccctgaagatttga

SEQ ID NO: 5817 - RNA, 1302 nt, synthetic construct
  misc_feature 1..1302: note = derived and/or modified CDS sequence (opt3) from PUUV(Munga/Mg16/05)__GQ339487.1__N
  source 1..1302: mol_type = other RNA
atgagcgacctgaccgatatccaggacgagattacaagacacgaacaacagctcgtggccgctaggcagaaacttaaagatgcagagcgggccgtcgaaatggaccccgatgacgttaacaagaatactctgcaggcgcgccaacagacggtgtccgctttggaggataaattagccgacttcaagcgacgtatggcagatgccgtatctagaaagaagatggacaccaagcctacagatccaactggcatagaaccggacgatcatctgaaagagaggtcaagtctacggtacgggaacgtgctcgacgtcaatgctatcgacattgaggaacccagcggacagaccgcagattggtatacaatcggtgtgtacgttattggctttaccctgcctatcatacttaaggccctgtatatgttgtccactcgcgggagacagacagtgaaagagaacaagggaaccaggatccggttcaaagacgatacgtcttttgaagacattaatggcatccgccgaccaaagcacctctacgtctcgatgcccactgctcaatcaaccatgaaggccgaggagctgacacctggtagattcaggactattgtgtgcgggctgtttccaacccagatccaggtacggaacataatgagccccgttatgggagtgattggcttctcctttttcgtcaaagattgggcggaacgtatccgcgagtttatggaaaaggagtgtcctttcattaaaccagaagtgaagccgggcacacccgcacaggagatcgagtttctcaaaaagaataaaatctatttcatgcaaagacaggacgtgttagataagaaccatgtcgccgacattgataagctgatagactacgctgccagtggggatcctacctctccagacaatatcgaaagccccaacgcaccttgggtttttgcttgcgccccagacaggtgtcccccgacgtgcatttatgtggcgggaatggccgagcttggtgcattcttctccatcttgcaggatatgcggaatactataatggcttcaaaaacagtaggcaccgccgaagagaagctgaaaaagaaaagtagcttttaccaatcttacctacgacgcactcagtccatggggattcagctcgaccagagaatcatcctgctttatatgctggaatggggaaaggagatggtggatcacttccatttgggcgacgatatggaccctgagctcaggggtctggctcaagccttaattgatcagaaggtcaaagaaatctcaaaccaggagcccctgaagatttga

SEQ ID NO: 5818 - RNA, 1302 nt, synthetic construct
  misc_feature 1..1302: note = derived and/or modified CDS sequence (opt3) from PUUV(Munga/Mg2/05)__GQ339486.1__N
  source 1..1302: mol_type = other RNA
atgagcgacctgaccgatatccaggacgagattacaagacacgaacaacagctcgtggccgctaggcagaaacttaaagatgcagagcgggccgtcgaaatggaccccgatgacgttaacaagaatactctgcaggcgcgccaacagacggtgtccgctttggaggataaattagccgacttcaagcgacgtatggcagatgccgtatctagaaagaagatggacaccaagcctacagatccaactggcatagaaccggacgatcatctgaaagagaggtcaagtctacggtacgggaacgtgctcgacatgaatgctatcgacattgaggaacccagcggacagaccgcagattggtatacaatcggtgtctacgtgattggctttaccctgcctatcatacttaaggccctgtatatgttgtccactcgcgggagacagacagttaaagagaacaagggaaccaggatccggttcaaagacgatacgtcttttgaagacattaatggcatccgccgaccaaagcacctctacgtgtcgatgcccactgctcaatcaaccatgaaggccgaggagctgacacctggtagattcaggactattgtctgcgggctgtttccaacccagatccaggtgcggaacataatgagccccgtaatgggagttattggcttctcctttttcgtgaaagattgggcggaacgtatccgcgagtttatggaaaaggagtgtcctttcattaaaccagaagtcaagccgggcacacccgcacaggagatcgagtttctcaaaaagaataaaatctatttcatgcaaagacaggacgtgttagataagaaccatgtggccgacattgataagctgatagactacgctgccagtggggatcctacctctccagacaatatcgaaagccccaacgcaccttgggtctttgcttgcgccccagacaggtgtcccccgacgtgcatttatgttgcgggaatggccgagcttggtgcattcttctccatcttgcaggatatgcggaatactataatggcttcaaaaacagtgggcaccgccgaagagaagctgaaaaagaaaagtagcttttaccaatcttacctacgacgcactcagtccatggggattcagctcgaccagagaatcatcctgctttatatgctggaatggggaaaggagatggtagatcacttccatttgggcgacgatatggaccctgagctcaggggtctggctcaagccttaattgatcagaaggtgaaagaaatctcaaaccaggagcccctgaagatttga

SEQ ID NO: 5819 - RNA, 1302 nt, synthetic construct
  misc_feature 1..1302: note = derived and/or modified CDS sequence (opt3) from PUUV(PUU/Cg-Erft)__AJ238779.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggccaaagcacctctacgtgtcgatgcccactgcccagtcaaccatgaaagctgaggagctgacacctggtcgcttccgaactattgtatgcgggctgtttccaacccagatccaggttagaaacataatgagccccgtgatgggagtcattggcttctcctttttcgtgaaggattgggccgacaggatcaaaaagtttatggaaaaagagtgtcctttcattaagccagaagtgaaaccgggcacacccagtcaagaggcggaatttctcaagatgaatcggatctatttcatgcagcgtcaggaggtcttagataagaaccatgttgcagacatcgataaactgattgactacgccgcttctggggatcctaccagcccagacaatatagaggcccccaacgcaccttgggtgtttgcttgcgccccagaccgctgtcccccgacgtgcatctatgtagcgggaatggccgaacttggtgcattcttctccattttgcaagatatgagaaatactatcatggcttcaaagacagtgggcaccgccgaggaaaaactgaagaaaaagagtagcttttaccagtcttacctaaggcggactcagtccatggggatacagctcgaccaacgaattatcctgctttatatgctggagtggggaaaggaaatggtcgatcacttccatttgggcgacgatatggaccctgagctccgcggtctggctcaggccttaatcgatcagaaagtgaaggagatttcaaaccaggaacccctgaaaatctga

SEQ ID NO: 5820 - RNA, 1302 nt, synthetic construct
  misc_feature 1..1302: note = derived and/or modified CDS sequence (opt3) from PUUV(Puu/Kazan)__Z84204.1__N
  source 1..1302: mol_type = other RNA
atgagcgacctgaccgatatccaggaggaaattacaagacacgagcaacagctcgtggtcgccaggcagaaacttaaagacgctgaacgggcagttgaggtggatcccgacgatgtaaacaagaatactctgcaggcccgccaacagacggtgtccgcgttggaagacaaattagctgattacaagcgacgtatggccgacgcagtctctagaaagaagatggataccaagcctacagacccaactggcatagagccggatgaccatctgaaagagaggtcaagtctacggtatgggaacgtgctcgatgttaatgccatcgacattgaggaacccagcggacagaccgctgactggtacacaatcggtgtgtatgtcattggcttcaccatccctataatcctgaaggcactttacatgctgtccactcgcgggagacagacagtgaaagaaaacaagggaaccaggattcggtttaaagatgacacgtctttcgaggatatcaatggcattcgccgaccaaagcacttgtatgtatcgatgcccactgcccaatcaaccatgaaggctgaggaactcacacctggtagatttaggactatcgtttgcgggctgttcccaacccagatacaggtgcggaacattatgagccccgtcatgggagtgatcggctttagtttctttgtgaaagactggcctgagcgtattcgcgatttcatggaaaaggagtccccatttatcaaaccggaagtcaagcccggcacccctgcccaggagatcgagttcctgaaaagaaatagggtttactttatgacacggcaagacgtgctcgataagaaccatgtagcggacattgataaattaatagactatgcagcctctggggatccaacgagccccgacgacatcgaatcccctaatgctccatgggtgttcgcctgtgcacccgatcgatgcccgcctacttgtatttacgtcgctggaatggccgagctgggtgcgtttttctcaatccttcaggacatgcgcaacacaataatggccagtaagaccgtgggcactgcagaagagaagttgaaaaagaaaagctctttctaccagtcctatctgagaaggacacaatcaatggggattcagctagatcagcggatcatcctcctgtacatgcttgaatggggaaaggagatggttgaccactttcatctgggcgatgacatggatcccgagttgcgcggtctcgctcagagcctgattgaccaaaaagtgaaggaaatcagtaatcaggagccattaaagatttga

SEQ ID NO: 5821 - RNA, 1302 nt, synthetic construct
  misc_feature 1..1302: note = derived and/or modified CDS sequence (opt3) from PUUV(PUU/Mignovillard/CgY02/2005)__AM695638.1__N
  source 1..1302: mol_type = other RNA
atgggcgacctgaccgatatccaggaggacattacaagacacgaacaacagctcgtggtcgccaggcagaagttaaaagatgctgagaaggcagttgaaatggaccccgatgacgtgaacaaaaatactctgcaggcccggcaacagacggtaagcgcgttggaggataagttagctgacttcaaacgccgaatggccgatgcagtgtcccgtaagaagatggacaccaaacctacagatccaactgggatagaaccggacgatcatctgaaggagagatcttcactaaggtacggaaacgtcctcgacgtgaatgccatcgacattgaggaacccagtggtcagaccgctgattggtatacaatcggcgtttacgtgattgggtttaccctgcctatcatacttaaagcactgtatatgttgagcactcggggacgccagacagtcaaggagaacaaaggcaccagaatcaggttcaaggacgatacgtcctttgaagacattaatggtatccggcgcccaaagcacctctacgtgtctatgcccactgcccaatcgaccatgaaagctgaggagctgacacctgggcgattcagaactattgtatgcggactgtttccaacccagatccaggttaggaacataatgtcacccgtgatgggcgtcattggcttcagctttttcgtgaaggattggacagaccggatccgtgaatttatggagaaagaatgtcctttcattaagccagagatgaaaccggggacccccgcccaggaagcggagtttctcaagcgcaataaaatctatttcatgcaaagacaggatgtgttagacaagaaccatgtcgcagatatcgacaagctgattgattacgccgctagtggagaccctacgtccccagacaatatagagtctcccaacgccccttgggtttttgcatgcgctccagataggtgtcccccgacttgcatctatgtggccggtatggcggaacttggcgccttcttcagcattttgcaggacatgcggaatacaatcatggcatccaaaaccgtagggactgctgaggaaaagctgaaaaagaaatcaagtttttaccaaagctacctacgacgcacacagtctatgggaatacagctcgatcagagaattatcctgctttatatgctggagtggggcaaggaaatggtggaccacttccatttgggtgatgacatggatcctgagctcagggggctggcccaagctcttatcgaccagaaggtcaaagagatttccaaccaggaacccctgaagatctga

SEQ ID NO: 5822 - RNA, 1302 nt, synthetic construct
  misc_feature 1..1302: note = derived and/or modified CDS sequence (opt3) from PUUV(PUUV/Croatia_Gerovo/Mg938/2008)__KC676609.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgatgggctttaccctgcctattatccttaaagcactgtatatgttgtccactcgggggcgccagacagtcaaggagaacaaaggaaccagaataaggttcaaggacgatacgtcttttgaagacatcaatggcattcggcgcccaaagcacctctacgtgtcgatgcccactgcccaatcaaccatgaaagctgaggagctgacacctggtcgattcagaactatcgtatgcgggctgtttccaacccagattcaggttaggaacatcatgagccccgtgatgggagtcataggcttctcctttttcgtgaaggattggagtgaacgggtgcgtgactttatggagaaagaatgtcctttcattaagccagagatcaaaccgggcacaccccagcaagaagccgagtttctcaagcgcaataaagtctatttcatgcagagacaggatgttttagacaagaaccatgtggcggatattgacaagctgatcgattacgcagcctctggggaccctaccagcccagacaatatcgagtcccccaacgctccttgggtatttgcctgcgcaccagataggtgtcccccgacgtgcatttatgtggctggaatggccgaacttggtgcgttcttctcaatattgcaagacatgcggaatactatcatggccagtaaaacagtcggcaccgcagaggaaaagctgaaaaagaaaagctctttttaccagtcctacctacgacgcactcagtcaatggggattcagctcgatcaaagaatcatactgctttatatgctggagtggggaaaggaaatggtggaccacttccatttgggcgatgacatggatcctgagctcaggggtctggctcaggccttaattgaccagaaggttaaagagatcagcaaccaggaacccctgaagatctga

SEQ ID NO: 5823 - RNA, 1302 nt, synthetic construct
  misc_feature 1..1302: note = derived and/or modified CDS sequence (opt3) from PUUV(PUUV/Croatia_Gerovo/Mg979/2008)__KC676613.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatgcgggctgtttccaacccagatccaggttaggaacataatgagccccgtgatgggagtcattggcttctcctttttcgtgaaggattggagtgaacgggtgcgtgactttatggagaaagaatgtcctttcatcaagccagagattaaaccgggcacaccccctcaggaagccgagtttctcaagcgcaataaagtctatttcatgcaaagacaggatgttttagacaagaaccatgtggcggatatcgacaagctgatcgattacgcagcctctggggacccaaccagccccgacaatattgagtcccctaacgctccatgggtatttgcctgcgcacccgataggtgtccgcctacgtgcatatatgtggctggaatggccgaacttggtgcgttcttctcaatcttgcaggacatgcggaatactattatggccagtaaaacagtcggcaccgcagaggaaaagctgaaaaagaaaagctctttttaccaatcctacctacgacgcactcagtcaatggggatccagctcgatcagagaataattctgctttatatgctggagtggggaaaggaaatggtggaccacttccatttgggcgatgacatggatcccgagctcaggggtctggctcaagccttaatcgaccagaaggttaaagagatcagcaaccaggaaccactgaagatttga

SEQ ID NO: 5824 - RNA, 1302 nt, synthetic construct
  misc_feature 1..1302: note = derived and/or modified CDS sequence (opt3) from PUUV(PUUV/Konnevesi/Mg_M114B/2005)__JQ319171.1__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgactacaagcgacgtatggccgatgcagtctctagaaagaagatggacaccaagcctacagatccaactggcatagaaccggacgatcatctgaaagagaggtcaagtctacggtatgggaacgtgctcgacgttaatgccatcgacattgaggaacccagcggacagaccgctgattggtacacaatcggtgtgtatgtcattggcttcaccctgcctatcatacttaaggcactgtacatgttgtccactcgcgggagacagacagtgaaagagaacaagggaaccaggatccggtttaaagacgatacgtctttcgaagacattaatggcatccgccgaccaaagcacctctatgtatcgatgcccactgcccaatcaaccatgaaggctgaggagctgacacctggtagatttaggactattgtttgcgggctgttcccaacccagatccaggtgcggaacataatgagccccgtcatgggagtgattggctttagtttctttgtgaaagattggcctgaacgtatccgcgagttcatggaaaaggagtgtccatttattaaaccggaagtcaagcccggcacccctgcccaggagatcgagatgctcaaaagaaataagatctacttcatgcaaaggcaggacgttttagataaaaaccatgtggcggacattgataagctgatagactatgcagcctccggggatccaacatctcccgacaatatcgacagccctaacgctccatgggtatttgcctgcgcacccgatcggtgtccgcctacgtgcatttacgtggctggaatggccgaacttggtgcgttcttttccatcttgcaggacatgcgaaatactataatggcctcaaagacagtcggcaccgcagaggaaaaactgaagaaaaagagtagcttctaccaatcttatctacgcagaactcagtccatggggattcagctcgatcagaggatcatcctgcttttcatgctggagtggggaaaagaaatggtggaccactttcatttcggcgatgacatggatcccgagttgcggggtctcgctcaagccctgattgaccagaaggttaaggagatctcaaaccaggaaccattaaaaatttga

SEQ ID NO: 5825 - RNA, 1302 nt, synthetic construct
  misc_feature 1..1302: note = derived and/or modified CDS sequence (opt3) from PUUV(PUUV/Konnevesi/Mg_M94A/2005)__JQ319163.2__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgactacaagcgacgtatggccgatgcagtctctagaaagaagatggacaccaagcctacagatccaactggcatagaaccggacgatcatctgaaagagaggtcaagtctacggtatgggaacgtgctcgacgttaatgccatcgacattgaggaacccagcggacagaccgctgattggtacacaatcggtgtgtatgtcattggcttcaccctgcctatcatacttaaggcactgtacatgttgtccactcgcgggagacagacagtgaaagagaacaagggaaccaggatccggtttaaagacgatacgtctttcgaagacattaatggcatccgccgaccaaagcacctctatgtatcgatgcccactgcccaatcaaccatgaaggctgaggagctgacacctggtagatttaggactattgtttgcgggctgttcccaacccagatccaggtgcggaacataatgagccccgtcatgggagtgattggctttagtttctttgtgaaagattggcctgaacgtatcaaggagttcatggaaaaagagtgtccatttattaagccggaagtcaaacccggcacccctgcccaggagatcgagatgctcaagcgcaataaaatctacttcatgcaaagacaggacgttttagataagaaccatgtggcggacattgataagctgatagactatgcagcctccggggatccaacatctcccgacaatatcgacagccctaacgctccatgggtatttgcctgcgcacccgataggtgtccgcctacgtgcatttacgtggctggaatggccgaacttggtgcgttcttttccatcttgcaggacatgcggaatactataatggcctcaaaaacagtcggcaccgcagaggaagaggtgaagaaaaagagtagcttctaccaatcttatctgcgacgcactcagtccatggggattcagctagatcagagaatcatcctcctgttcatgcttgaatggggaaaagagatggttgaccactttcatctgggcgatgacatggatcccgagttgaggggtctcgctcaagccatgattgaccagaaggtgaaggaaatctcaaaccaggagccactgaaaatttga

SEQ ID NO: 5826 - RNA, 1302 nt, synthetic construct
  misc_feature 1..1302: note = derived and/or modified CDS sequence (opt3) from PUUV(PUUV/Konnevesi/Mg_O14B/2005)__JQ319166.1__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgactacaagcgacgtatggccgatgcagtctctagaaagaagatggacaccaagcctacagatccaactggcatagaaccggacgatcatctgaaagagaggtcaagtctacggtatgggaacgtgctcgacgttaatgccatcgacattgaggaacccagcggacagaccgctgattggtacacaatcggtgtgtatgtcattggcttcaccctgcctatcatacttaaggcactgtacatgttgtccactcgcgggagacagacagtgaaagagaacaagggaaccaggatccggtttaaagacgatacgtctttcgaagacattaatggcatccgccgaccaaagcacctctatgtatcgatgcccactgcccaatcaaccatgaaggctgaggagctgacacctggtagatttaggactattgtttgcgggctgttcccaacccagatccaggtgcggaacataatgagccccgtcatgggagtgattggctttagtttctttgtgaaagattggcctgaacgtatccgcgagttcatggaaaaggagtgtccatttattaaaccggaagtcaagcccggcacccctgcccaggagatcgagatgctcaaaagaaataagatctacttcatgcaaaggcaggacgttttagataaaaaccatgtggcggacattgataagctgatagactatgcagcctccggggatccaacatctcccgacaatatcgacagccctaacgctccatgggtatttgcctgcgcacccgatcggtgtccgcctacgtgcatttacgtggctggaatggccgaacttggtgcgttcttttccatcttgcaggacatgcgaaatactataatggcctcaaagacagtcggcaccgcagaggaaaaactgaagaaaaagagtagcttctaccaatcttatctacgcagaactcagtccatggggattcagctcgatcagaggatcatcctgcttttcatgctggagtggggaaaagaaatggtggaccactttcatttgggcgatgacatggatcccgagctccggggtctggctcaagccttaattgaccagaaggttaaggagatctcaaaccaggaaccactgaaaatttga

SEQ ID NO: 5827 - RNA, 1302 nt, synthetic construct
  misc_feature 1..1302: note = derived and/or modified CDS sequence (opt3) from PUUV(PUUV/Konnevesi/Mg_O22B/2005)__JQ319168.2__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgactacaagcgacgtatggccgatgcagtctctagaaagaagatggacaccaagcctacagatccaactggcatagaaccggacgatcatctgaaagagaggtcaagtctacggtatgggaacgtgctcgacgttaatgccatcgacattgaggaacccagcggacagaccgctgattggtacacaatcggtgtgtatgtcattggcttcaccctgcctatcatacttaaggcactgtacatgttgtccactcgcgggagacagacagtgaaagagaacaagggaaccaggatccggtttaaagacgatacgtctttcgaagacattaatggcatccgccgaccaaagcacctctatgtatcgatgcccactgcccaatcaaccatgaaggctgaggagctgacacctggtagatttaggactattgtttgcgggctgttcccaacccagatccaggtgcggaacataatgagccccgtcatgggagtgattggctttagtttctttgtgaaagattggcctgaacgtatccgcgagttcatggaaaaggagtgtccatttattaaaccggaagtcaagcccggcacccctgcccaggagatcgagatgctcaaaagaaataagatctacttcatgcaaaggcaggacgttttagataaaaaccatgtggcggacattgataagctgatagactatgcagcctccggggatccaacatctcccgaaaatatcgacagccctaacgctccatgggtatttgcctgcgcacccgaccggtgtccgcctacgtgcatttacgtggctggaatggccgagcttggtgcgttcttttccatcttgcaggatatgcgaaatactataatggcctcaaagacagtcggcaccgcagaagagaaactgaagaaaaagagtagcttctaccaatcttatctacgcagaactcagtccatggggattcagctcgaccagaggatcatcctgcttttcatgctggaatggggaaaagagatggtggatcactttcatttgggcgacgatatggaccccgagctccggggtcacgctcaagccctgattgatcagaaggttaaggaaatctcaaaccaggagccattaaaaatttga

SEQ ID NO: 5828 - RNA, 1302 nt, synthetic construct
  misc_feature 1..1302: note = derived and/or modified CDS sequence (opt3) from PUUV(PUUV/Konnevesi/Mg_O57A/2005)__JQ319161.2__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgactacaagcgacgtatggccgatgcagtctctagaaagaagatggacaccaagcctacagatccaactggcatagaaccggacgatcatctgaaagagaggtcaagtctacggtatgggaacgtgctcgacgttaatgccatcgacattgaggaacccagcggacagaccgctgattggtacacaatcggtgtgtatgtcattggcttcaccctgcctatcatacttaaggcactgtacatgttgtccactcgcgggagacagacagtgaaagagaacaagggaaccaggatccggtttaaagacgatacgtctttcgaagacattaatggcatccgccgaccaaagcacctctatgtatcgatgcccactgcccaatcaaccatgaaggctgaggagctgacacctggtagatttaggactattgtttgcgggctgttcccaacccggatccaggtgcgtaacataatgagccccgtcatgggagtgattggctttagtttctttgtgaaagattggcctgaacgcatcaaggagttcatggaaaaagagtgttcctttattaagccagaagtcaaaccgggcacacccgcccaggagatcgagatgctcaagagaaataaaatctacttcatgcagaggcaagacgttttagataagaaccatgtggcggacattgataagctgatagactatgcagcctctggggatcctaccagcccagacaatatcgactcccccaacgctccttgggtatttgcctgcgcaccagatcggtgtcccccgacgtgcatttacgtggctggaatggccgaacttggtgcgttcttttcaatcttgcaggacatgcgaaatactataatggccagtaaaacagtcggcaccgcagaggaagaggtgaagaaaaagagctctttctaccagtcctatctgcgcagaactcaatcaatggggattcagctagatcagaggatcatcctcctgttcatgcttgaatggggaaaagagatggttgaccactttcatctgggcgatgacatggatcctgagttgcggggtctcgctcaggccctgattgaccaaaacgtgaaggaaatcagcaatcaggagcccttaaagatttga

SEQ ID NO: 5829 - RNA, 1302 nt, synthetic construct
  misc_feature 1..1302: note = derived and/or modified CDS sequence (opt3) from PUUV(PUUV/Konnevesi/Mg_O6B/2005)__JQ319164.1__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgactacaagcgacgtatggccgatgcagtctctagaaagaagatggacaccaagcctacagatccaactggcatagaaccggacgatcatctgaaagagaggtcaagtctacggtatgggaacgtgctcgacgttaatgccatcgacattgaggaacccagcggacagaccgctgattggtacacaatcggtgtgtatgtcattggcttcaccctgcctatcatacttaaggcactgtacatgttgtccactcgcgggagacagacagtgaaagagaacaagggaaccaggatccggtttaaagacgatacgtctttcgaagacattaatggcatccgccgaccaaagcacctctatgtatcgatgcccactgcccaatcaaccatgaaggctgaggagctgacacctggtagatttagggccattgtttgcgggctgttcccaactcagatccaggtgcggaacataatgagccccgtcatgggagtgattggctttagtttctttgtgaaagattggcctgaacgtatccgcgagttcatgggcaaggaatgtccatttattaaaccggaggtcaagcccgggacccctgcgcaggaaatcgagatgctcaaaagaaataagatctacttcatgcaaaggcaggacgttttagataaaaaccatgtggcagacattgataagctgatagactatgccgcttccggagatccaacatctcccgacaatatcgacagccctaacgccccatgggtatttgcatgcgctcccgatcggtgtccgcctacctgcatttacgtggccggtatggcggagcttggcgccttcttttccatcttgcaggacatgcgaaatacgataatggcatcaaagactgtcgggacagctgaagagaaactgaagaaaaagagtagcttctaccaatcttatctacgcagaacccagtccatgggcattcagctcgatcagaggatcatcctgcttttcatgctggaatggggaaaagagatggtggaccactttcatttgggtgatgacatggatcccgaactccgggggctggcccaggctttaattgaccaaaaggttaaggagatctcaaaccaggagccactgaaaatttga

SEQ ID NO: 5830 - RNA, 1302 nt, synthetic construct
  misc_feature 1..1302: note = derived and/or modified CDS sequence (opt3) from PUUV(PUUV/Konnevesi/Mg_O74B/2005)__JQ319170.1__N
  source 1..1302: mol_type = other RNA
atgagcgacctgaccgatatccaggaggacattacaagacacgaacaacagctcgtggtcgccaggcagaaacttaaagatgctgagcgggcagttgaagtggaccccgatgacgtaaacaagaatactctgcaggcccgccaacagacggtgtccgcgttggaggataaattagctgactacaagcgacgtatggccgatgcagtctctagaaagaagatggacaccaagcctacagatccaactggcatagaaccggacgatcatctgaaagagaggtcaagtctacggtatgggaacgtgctcgacgttaatgccatcgacattgaggaacccagcggacagaccgctgattggtacacaatcggtgtgtatgtcattggcttcaccctgcctatcatacttaaggcactgtacatgttgtccactcgcgggagacagacagtgaaagagaacaagggaaccaggatccggtttaaagacgatacgtctttcgaagacattaatggcatccgccgaccaaagcacctctatgtatcgatgcccactgcccaatcaaccatgaaggctgaggagctgacacctggtagatttaggactattgtttgcgggctgttcccaacccagatccaggtgcggaacataatgagccccgtcatgggagtgattggctttagtttctttgtgaaagattggcctgaacgtatccgcgagttcatggaaaaggagtgtccatttattaaaccggaagtcaagcccggcacccctgcccaggagatcgagatgctcaaaagaaataagatctacttcatgcaaaggcaggacgttttagataaaaaccatgtggcggacattgataagctgatagactatgcagcctccggggatccaacatctcccgacaatatcgacagccctaacgctccatgggtatttgcctgcgcacccgatcggtgtccgcctacgtgcatttacgtggctggaatggccgaacttggtgcgttcttttccatcttgcaggacatgcgaaatactataatggcctcaaagacagtcggcaccgtggaggaaaaactgaagaaaaagagtagcttctaccaatcttatctacgcagaactcagtccatggggattcagctcgatcagaggatcatcctgcttttcatgctggagtggggaaaagaaatggttgaccactttcatttgggcgatgacatggatcccgagctccggggtctggcacaggctttaattgaccaaaaggtgaaggagatctcaaaccaggaaccactgaaaatttga

SEQ ID NO: 5831 - RNA, 1302 nt, synthetic construct
  misc_feature 1..1302: note = derived and/or modified CDS sequence (opt3) from PUUV(PUUV/Konnevesi/Mg_O78A/2005)__JQ319162.2__N
  source 1..1302: mol_type = other RNA
atgagcgacctgaccgatatccaggaggacattacaagacacgaacaacagctcgtggtcgccaggcagaagctgaaagatgctgagaaggcagttgaagtggaccccgatgacgtaaacaaaaatactcttcaggcccggcaacagacggtgtccgcgttggaggataagttagctgactacaaacgccgaatggccgatgcagtctctcgtaagaagatggacaccaaacctacagatccaactggcatagaaccggacgatcatctgaaggagagatcaagtctaaggtatgggaacgtgctcgacgttaatgccatcgacattgaggaacccagcggacagaccgctgattggtacacaatcggtgtgtatgtcattggcttcaccctgcctatcatacttaaagcactgtacatgttgtccactcgggggcgccagacagtgaaggagaacaaaggaaccagaatcaggtttaaggacgatacgtctttcgaagacattaatggcatccggcgcccaaagcacctctatgtatcgatgcccactgcccaatcaaccatgaaagctgaggagctgacacctggtcgatttagaactattgtttgcgggctgttcccaacccagatccaggtgaggaacataatgagccccgtcatgggagtgattggctttagtttctttgtgaaggattggcctgaacggatccgtgagttcatggaaaaagagtgtccatttattaagccggaagtcaaacccggcacccctgcccaggagatcgagatgctcaagcgcaataaaatctacttcatgcaaagacaggacgttttagataagaaccatgtggcggacattgataagctgatagactatgcagcctccggggatccaacatctcccgacaatatcgacagccctaacgctccatgggtacttgcctgcggacccgaaaggtgtccgcctacgtgcatttacgtggcaggtatggctgagttgggcgcctttttctccatcctgcaggatatgcggaatactataatggcgtcaaaaacagtcgggagtgacgaagtgaagctaaagaaaaagagctttttctaccaatattacctccgacgcacccactctatgggcattcagctggatcagagaatcatccttctgtgtatgttggagtggggaattgaaatggttgaccatttccacctcggtgatgacatggatcccgagctgagggggttagcccaggcaatgatcgaccaaaaagtgaaggagatttccaaccaggaaccactgataatctga

SEQ ID NO: 5832 - RNA, 1302 nt, synthetic construct
  misc_feature 1..1302: note = derived and/or modified CDS sequence (opt3) from PUUV(PUUV/Mg23/HungaryTR17/00)__FN377822.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccgaatggccgatgcagtgtctcgtaagaagatggacaccaaacctacagatccaactggcatagaaccggacgatcatctgaaggagagatcaagtctaaggtacgggaacgtcctcgacgtgaatgccatcgacattgaggaacccagcggacagaccgctgattggtatacaatcggtgtttacgtgattggctttaccctgcctatcatacttaaagcactgtatatgttgtccactcgggggcgccagacagtcaaggagaacaaaggaaccagaatcaggttcaaggacgatacgtcttttgaagacattaatggcatccggcgcccaaagcacctctacgtgtcgatgcccactgcccaatcaaccatgaaagctgaggagctgacacctggtcgattcagaactattgtatgcgggctgtttccaacccagatccaggttaggaacataatgagccccgtgatgggagtcattggcttctcctttttcgtgaaggattggagtgaacgggtgcgtgagtttatggaaaaagagtgtcctttcatcaagccagaaattaaaccgggcacaccccctcaggaggccgagtttctcaagcgcaataaagtctatttcatgcaaagacaggacgttttagataagaaccatgtggcggacatcgataagctgatcgactacgcagcctctggggatccaaccagccccgacaatattgaatcccctaacgctccatgggtatttgcctgcgcacccgacaggtgtccgcctacgtgcatatatgtggctggaatggccgagcttggtgcgttcttctcaatcttgcaggatatgcggaatactattatggccagtaaaacagtcggcaccgcagaagagaagctgaaaaagaaaagctctttttaccaatcctacctacgacgcactcagtcaatggggatccagctcgaccagagaataattctgctttatatgctggaatggggaaaggagatggtggatcacttccatttgggcgacgatatggaccccgagctcaggggtctggctcaagccttaatcgatcagaaggttaaagaaatcagcaaccaggagccactgaagatttga

SEQ ID NO: 5833 - RNA, 1302 nt, synthetic construct
  misc_feature 1..1302: note = derived and/or modified CDS sequence (opt3) from PUUV(PUUV/Mg9/HungaryTR17/00)__FN377821.1__N
  source 1..1302: mol_type = other RNA
atgagcgacctggccgatatccaggaggacattaccagacacgaacaacagctcgtggtcgctaggcagaagttaaaagatgcagagaaggccgttgaaatggaccccgatgacgtgaacaaaaatacactgcaggcgcggcaacagactgtatccgctttggaggataagttagccgacttcaaacgccgaatggcagatgccgtgtctcgtaagaagatggacacgaaacctaccgatccaacaggcatagaaccggacgatcatctgaaggagagatcaagtctaaggtacgggaacgtcctcgacgtgaatgctatcgacattgaggaacccagcggacagactgcagattggtataccatcggtgtttacgtgattggctttacactgcctatcatacttaaagccctgtatatgttgtccacccgggggcgccagactgtcaaggagaacaaaggaacaagaatcaggttcaaggacgatacctcttttgaagacattaatggcatccggcgcccaaagcacctctacgtgtcgatgcccacggctcaatcaactatgaaagccgaggagctgacccctggtcgattcagaacaattgtatgcgggctgtttccaactcagatccaggttaggaacataatgagccccgtgatgggagtcattggcttctcctttttcgtgaaggattggagtgaacgggtgcgtgagtttatggaaaaagagtgtcctttcatcaagccagaaattaaaccgggcacaccccctcaggaggcggagtttctcaagcgcaataaagtctatttcatgcaaagacaggacgttttagataagaaccatgtggcagacatcgataagctgatcgactacgccgcttctggggatccaaccagccccgacaatattgaatcccctaacgccccatgggtatttgcatgcgctcccgacaggtgtccgcctacctgcatatatgtggccggaatggcggagcttggtgccttcttctcaatcttgcaggatatgcggaatacgattatggcaagtaaaactgtcggcacagctgaagagaagctgaaaaagaaaagctctttttaccaatcctacctacgacgcacccagtcaatggggatccagctcgaccagagaataattctgctttatatgctggaatggggaaaggagatggtggatcacttccatttgggcgacgatatggaccccgagctcaggggtctggcccaagctcttatcgatcagaaggttaaagaaatcagcaaccaggagccactgaagatttga

SEQ ID NO: 5834 - RNA, 1302 nt, synthetic construct
  misc_feature 1..1302: note = derived and/or modified CDS sequence (opt3) from PUUV(PUUV/NL/Mg1012/2010)__KU314900.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgactacaaacgccgaatggccgatgcagtgtctcgtaagaagatggacaccaaacctacagatccaactggcatagaaccggacgatcatctgaaggagagatcaagtctaaggtatgggaacgtcctcgacgtgaatgccatcgacattgaggaacccagcggacagaccgctgattggtacacaatcggtgtttatgtgattggcttcaccctgcctatcatacttaaagcactgtacatgttgtccactcgggggcgccagacagtcaaggagaacaaaggaaccagaatcaggtttaaggacgatacgtctttcgaagacattaatggcatccggcgcccaaagcacctctatgtgtcgatgcccactgcccaatcaaccatgaaagctgaggagctgacacctggtcgatttagaactattgtatgcgggctgttcccaacccagatccaggttaggaacataatgagccccgtgatgggagtcattggctttagtttctttgtgaaggattggcctgaccggatccgtgagttcatggaaaaagaatgtccatttattaagccggaggtgaaacccggcacccctgcccaggaagcggagttcctcaagcgcaataaagtctactttatgcaaagacaggatgttttagacaagaaccatgtggcagatatcgacaagctgatcgattatgccgcttccggggacccaacatctcccgacaatattgagagccctaacgccccatgggtattcgcatgcgctcccgataggtgtccgcctacgtgcatatacgtggccggaatggcggaacttggtgcctttttctccatcttgcaggacatgcggaatactattatggcatcaaaaacagtcggcgctgccgaggaaaagctgaaaaagaaaagtagcttctaccaatcttatctacgacgcacccagtccatggggatccagctcgatcagagaataattctgctttacatgctggagtggggaaaggaaatggtggaccactttcatttgggcgatgacatggatcccgagctcaggggtctggctcaagccttaatcgaccagaaggttaaagagatctcaaaccaggaaccactgaagatttga

SEQ ID NO: 5835 - RNA, 1302 nt, synthetic construct
  misc_feature 1..1302: note = derived and/or modified CDS sequence (opt3) from PUUV(PUUV/NL/Mg1439/2011)__KU314901.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgactacaaacgccgaatggccgatgcagtgtctcgtaagaagatggacaccaaacctacagatccaactggcatagaaccggacgatcatctgaaggagagatcaagtctaaggtatgggaacgtcctcgacgtgaatgccatcgacattgaggaacccagcggacagaccgctgattggtacacaatcggtgtttatgtgattggcttcaccctgcctatcatacttaaagcactgtacatgttgtccactcgggggcgccagacagtcaaggagaacaaaggagccagaatcaggtttaaggacgatacctctttcgaagacattaatggcatccggcgcccaaagcacctctatgtgtcgatgcccacggctcaatcaactatgaaagccgaggagctgacccctggtcgatttagaacaattgtatgcgggctgttcccaactcagatccaggttaggaacataatgagccccgtgatgggagtcattggctttagtttctttgtgaaggattggcctgaccggatccgtgagttcatggaacgcgaatgtccatttattaaaccggaggtgaagcccggcacccctgcgcaggaagcagagttcctcaaaagaaataaggtctactttatgcaaaggcaggatgttttagacaaaaaccatgtggccgatatcgacgagctgatcgattatgctgcctccggggacccaacatctcccgacaatattgaaagccctaacgcaccatgggtattcgcttgcgcccccgatcggtgtccgcctacctgcatatacgtggcgggaatggccgagcttggtgcatttttctccatcttgcaggacatgcgaaatacgattatggcttcaaagactgtcggcacagccgaagagaagctgaaaaagaaaagtagcttctaccaatcttatctacgcagaacccagtccatggggatccagctcgatcagaggataattctgctttacatgctggaatggggaaaggagatggtggaccactttcatttgggcgatgacatggatcccgagctccggggtctggctcaagccttaatcgaccagaaagttaaggaaatctcaaaccaggagccactgaagatttga

SEQ ID NO: 5836 - RNA, 1302 nt, synthetic construct
  misc_feature 1..1302: note = derived and/or modified CDS sequence (opt3) from PUUV(PUUV/NL/Mg2/2008)__KU314902.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaactacgctgcaggcccggcaacagaccgtatccgcgttggaggataagttagctgacttcaaacgccagatggccgatgcagtgtctcgaaagaagatggacacaaaacctgccgatccaactggcatagaaccggacgatcatctgaaggagcgttcaagtctaagatacgggaatgtcctcgacgtgaacgctatcgacattgaggaacccagcggacagaccgcagattggtatacaatcggtgtttacgtgattggctttaccctgcctatcatacttaaagccctgtatatgttgtccactagggggcggcaaacagtcaaggagaataaaggaacccgcatcagattcaaggacgatacgtcttttgaagacattaacggcatcaggcggccaaagcacctctacgtgtcgatgcccactgctcagtcaaccatgaaagccgaggagctgacacctggtcgcttccgaactattgtatgcgggctgtttccaacccagatccaggttagaaatataatgagccccgtgatgggagtcattggcttctcctttttcgtgaaggattgggcggacaggatccgggaatttatggagaaagaatgtcctttcattaagccagatgtgaaaccgggcacacccgcacaagaggccgaatttctcaagcgtaacaaaatctatttcatgcagcgccaggaggtcttagacaagaatcatgttgctgatatcgacaagctgattgattacgccgcaagtggggaccctacctctccagacaacatagagagccccaattccccttgggtgtttgcttgcgccccagatagatgtcccccgacgtgcatctatgtagcgggaatggccgaacttggtgcattcttctcaattttgcaagacatgaggaacactatcatggctagtaaaacagtgggcaccgccgaggaaaagctgaaaaagaaaagctctttttaccagtcctacctacggcgaactcagtcaatggggatacagctcgatcaacgcattatcctgctttatatgctggagtggggaaaggaaatggtcgaccacttccatttgggcgatgacatggatcctgagctcagaggtctggctcaggccttaatcgaccagaaggtggaggaaattagcaatcaggagcccctgaaaatctga

SEQ ID NO: 5837 - RNA, 1302 nt, synthetic construct
  misc_feature 1..1302: note = derived and/or modified CDS sequence (opt3) from PUUV(PUUV/NL/Mg25/2007)__KU314897.1__N
  source 1..1302: mol_type = other RNA
atgagcgacctgaccgatatccaggaggacattacaagacacgaacaacagctcgtggtcgccaggcagaagttaaaagatgctgagaaggcagttgaaatggaccccgatgacgtgaacaaaaatactctgcaggcccggcaacagacggtatccgcgttggaggataagttagctgactacaaacgccgaatggccgatgcagtgtctcgtaagaagatggacaccaaacctacagatccaactggcatagaaccggacgatcatctgaaggagagatcaagtctaaggtatgggaacgtcctcgacgtgaatgccatcgacattgaggaacccagcggacagaccgctgattggtacacaatcggtgtttatgtgattggcttcaccctgcctatcatacttaaagcactgtacatgttgtccactcgggggcgccagacagtcaaggagaacaaaggaaccagaatcaggtttaaggacgatacgtctttcgaagacattaatggcatccggcgcccaaagcacctctatgtgtcgatgcccactgcccaatcaaccatgaaagctgaggagctgacacctggtcgatttagaactattgtatgcgggctgttcccaacccagatccaggttaggaacataatgagccccgtgatgggagtcattggctttagtttctttgtgaaggattggcctgaccggatccgtgagttcatggaaaaagaatgtccatttattaagccggaggtgaaacccggcacccctgcccaggaagcggagttcctcaagcgcaataaagtctactttatgcaaagacaggatgttttagacaagaaccatgtggcagatatcgacaagctgatcgattatgccgcttccggggacccaacatctcccgacaatattgagagccctaacgccccatgggtattcgcatgcgctcccgataggtgtccgcctacgtgcatatacgtggccggaatggcggaacttggtgcctttttctccatcttgcaggacatgcggaatactattatggcatcaaaaacagtcggcaccgctgaggaaaagctgaaaaagaaaagtagcttctaccaatcttatctacgacgcactcagtccatggggatccagctcgatcagagaataattctgctttacatgctggagtggggaaaggaaatggtggaccactttcatttgggcgatgacatggatcccgagctcaggggtctggcccaagctcttatcgaccagaaggttaaagagatctcaaaccaggaaccactgaagatttga

SEQ ID NO: 5838 - RNA, 1302 nt, synthetic construct
  misc_feature 1..1302: note = derived and/or modified CDS sequence (opt3) from PUUV(PUUV/NL/Mg31/2007)__KU314896.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgactacaaacgccgaatggccgatgcagtgtctcgtaagaagatggacaccaaacctacagatccaactggcatagaaccggacgatcatctgaaggagagatcaagtctaaggtatgggaacgtcctcgacgtgaatgccatcgacattgaggaacccagcggacagaccgctgattggtacacaatcggtgtttatgtgattggcttcaccctgcctatcatacttaaagcactgtacatgttgtccactcgggggcgccagacagtcaaggagaacaaaggaaccagaatcaggtttaaggacgatacgtctttcgaagacattaatggcatccggcgcccaaagcacctctatgtgtcgatgcccactgcccaatcaaccatgaaagctgaggagctgacacctggtcgatttagaactattgtatgcgggctgttcccaacccagatccaggttaggaacataatgagccccgtgatgggagtcattggctttagtttctttgtgaaggattggcctgaccggatccgtgagttcatggaaaaagaatgtccatttattaagccggaggtgaaacccggcacccctgcccaggaagcggagttcctcaagcgcaataaagtctactttatgcaaagacaggatgttccagacaagaaccatgtggcagatatcgacaagttaatcgattatgccgcttccggggaccccacatctcctgacaatattgagagcccaaacgccccctgggtattcgcatgcgctccggataggtgtcctcccacgtgcatatacgtggccggaatggcggaactgggtgcctttttctccatccttcaggacatgcggaatactattatggcatcaaaaacagtcggcaccgctgaggaaaagttgaaaaagaaaagtagcttctaccaatcttatctgcgacgcactcagtccatggggatccagctagatcagagaataattctcctgtacatgcttgagtggggaaaggaaatggtggaccactttcatctgggcgatgacatggatccagagttgaggggtctcgcccaagctctgatcgaccagaaggttaaagagatctcaaaccaggaacctttaaagatttga

SEQ ID NO: 5839 - RNA, 1302 nt, synthetic construct
  misc_feature 1..1302: note = derived and/or modified CDS sequence (opt3) from PUUV(PUUV/NL/Mg502/2008)__KU314904.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctgccgatccaacaggcatagaaccggacgatcatctgaaggagcgttcaagtctaagatacgggaacgtcctcgacgtgaatgctatcgacattgaggaacccagcggacagactgcagattggtataccatcggtgtttacgtgattggctttacactgcctatcatacttaaagccctgtatatgttgtccaccagggggcggcaaactgtcaaggagaacaaaggaacacgcatcagattcaaggacgatacctcttttgaagacattaatggcatcaggcggccaaagcacctctacgtgtcgatgcccacggctcagtcaactatgaaagccgaggagctgacccctggtcgcttccgaacaattgtatgcgggctgtttccaactcagatccaggttagaaacataatgagccccgtgatgggagtcattggcttctcctttttcgtgaaggattgggcggacaggatccgggaatttatggagaaagaatgtcctttcattaagccagatgtgaaaccgggcacccccgcacaagaggccgaatttctcaagcgtaataaaatctatttcatgcagcgccaggaggtcttagacaagaaccatgttgctgatatcgacaagctgattgattacgccgcaagtggggaccctacatctccagacaatatagagagccccgattccccttgggtgtttgcttgcgccccagacagatgtcccccgacctgcatctatgtagcgggaatggccgaacttggtgcattcttctcaattttgcaagatatgaggaacacgatcatggctagtaaaactgtgggcacagccgaggaaaagctgaaaaagaaaagctctttttaccagtcctacctacggcgaacccagtcaatggggatacagctcgaccaacgcattatcctgctttatatgctggagtggggaaaggaaatggtcgatcacttccatttgggcgacgatatggaccctgagctcagaggtctggctcaggccttaatcgatcagaaggtgaaagagattagcaatcaggaacccctgaagatctga

SEQ ID NO: 5840 - RNA, 1302 nt, synthetic construct
  misc_feature 1..1302: note = derived and/or modified CDS sequence (opt3) from PUUV(PUUV/NL/Mg591/2008)__KU314905.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggccaaagcacctctacgtgtcgatgcccactgcccagtcaaccatgaaagctgaggagctgacacctggtcgcttccgaactattgtatgcgggctgtttccaacccagatccaggttagaaacataatgagccccgtgatgggagtcattggcttctcctttttcgtgaaggattgggccgacaggatccgggaatttatggagaaagaatgtcctttcattaagccagatgtgaaaccgggcacacccgcgcaagaggcagaatttctcaagcgtaataaaatctatttcatgcagcgccaggaggtcttagacaagaaccatgttgccgatatcgacaagctgattgattacgctgccagtggggaccctacctctccagacaatatagagagccccaactccccttgggtgtttgcatgcgctccagatagatgtcccccgacgtgcatctatgtagccggaatggcggaacttggtgccttcttctcaattttgcaagacatgaggaatactatcatggcaagtaaaacagtgggcaccgctgaggaaaagctgaaaaagaaaagctctttttaccagtcctacctacggcgaactcagtcaatggggatacagctcgatcaacgcattatcctgctttatatgctggagtggggaaaggaaatggtcgaccacttccatttgggcgatgacatggatcctgagctcagaagcctggcccaggctttaatcgaccagaaggtgaaagagattagtaaccaggaacccctgaagatctga

SEQ ID NO: 5841 - RNA, 1302 nt, synthetic construct
  misc_feature 1..1302: note = derived and/or modified CDS sequence (opt3) from PUUV(Samara_49/CG/2005)__AB433843.2__N
  source 1..1302: mol_type = other RNA
atgagcgacctgaccgatatccaggaggaaattacaagacacgagcaacagctcgtggtcgccaggcagaaacttaaagacgctgaacgggcagttgaggtggatcccgacgatgtaaacaagaatactctgcaggcccgccaacagacggtgtccgcgttggaagacaaattagctgattacaagcgacgtatggccgacgcagtctctagaaagaagatggataccaagcctacagacccaactggcatagagccggatgaccatctgaaagagaggtcaagtctacggtatgggaacgtgctcgatgttaatgccatcgacattgaagaacccagcggacagaccgctgactggtacacaatcggtgtgtatgtcattggcttcaccatccctataatcctgaaggcactttacatgctgtccactcgcgggagacagacagtgaaagaaaacaagggaaccaggattcggtttaaagatgacacgtctttcgaggatatcaatggcattcgccgaccaaagcacttgtatgtatcgatgcccactgcccaatcaaccatgaaggctgaggaactcacacctggtagatttaggactatcgtttgcgggctgttcccaacccagatacaggtgcggaacattatgagccccgtcatgggagtgatcggctttagtttctttgtgaaagactggcctgagcgtattcgcgagttcatggagagagaatgtccatttatcaagccggaggtcaaacccggcacccctgcccaggaggttgagttcctgaagaggaatcgggtgtactttatgacacgacaagatgtactcgacaaaaaccatgtggcggatatcgacaagttaattgattatgcagcctccggggacccaacgtctcccgatgacatagaaagccctaatgctccatgggtcttcgcctgcgcacccgaccgctgtccgcctacttgcatctacgtggctggaatggccgaactgggtgcgtttttctccattcttcaggatatgagaaacacaatcatggcctcaaaaaccgttggcactgcagaggaaaagttgaagaaaaagagtagcttctaccagtcttatctgaggcggacacaatccatggggatacagctagaccagcgcattatcctcctgtacatgcttgagtggggaaaagagatggtggatcactttcatctgggcgacgatatggaccccgaattgagaggtctcgctcagtcactgatcgatcaaaaggtcaaagagattagcaatcaggaaccattaaagatctga

SEQ ID NO: 5842 - RNA, 1302 nt, synthetic construct
  misc_feature 1..1302: note = derived and/or modified CDS sequence (opt3) from PUUV(Thuin/33Cg/96)__AJ277030.1__N
  source 1..1302: mol_type = other RNA
atgagcgacctgaccgatatccaggaggacattacaagacacgaacaacagctcgtggtcgccaggcagaaacttaaggatgctgagaaggcagttgaaatggaccccgatgacgtgaacaaaaatactctgcaggcccggcaacagacggtatccgcgttggaggataagttagctgacttcaaacgccagatggccgatgcagtgtctcgaaagaagatggacaccaaacctacagatccaactggcatagaaccggacgatcatctgaaggagcgttcaagtctaagatacgggaacgtcctcgacgtgaatgccatcgacattgaggaacccagcggacagaccgctgattggtatacaatcggtgtttacgtgattggctttaccctgcctatcatacttaaagcactgtatatgttgtccactagggggcggcaaacagtcaaggagaacaaaggaacccgcatcagattcaaggacgatacgtcttttgaagacattaatggcatcaggcggccaaagcacctctacgtgtcgatgcccactgcccagtcaaccatgaaagctgaggagctgacacctggtcgcttccgaactattgtatgcgggctgtttccaacccagatccaggttagaaacataatgagccccgtgatgggagtcattggcttctcctttttcgtgaaggattgggccgacaggatccgggaatttatggagaaagaatgtcctttcattaagccagaggtgaaaccgggcacacccgtccaagaagcggagtttctcaagcgtaataaaatctatttcatgcagcgccaggaggttttagataagaaccatgtggcagacatcgataagctgattgactacgccgctagtggggatcctacctctccagacaatatagaagcccccaacgcaccttgggtatttgcttgcgccccagacagatgtcccccgacgtgcatctatgtggcgggaatggccgagcttggtgcattcttcagcattttgcaagatatgaggaatactatcatggcttccaaaacagtcggcaccgccgaagagaagctgaaaaagaaatcaagtttttaccagagctacctacggcgaactcagtctatggggatacagctcgaccaacgcattatcctgctttatatgctggaatggggaaaggagatggtggatcacttccatttgggcgacgatatggaccctgagctcagaggtctggctcaggccttaatcgatcagaaggttaaagaaatttccaaccaggagcccctgaagatctga

SEQ ID NO: 5843 - RNA, 1302 nt, synthetic construct
  misc_feature 1..1302: note = derived and/or modified CDS sequence (opt3) from PUUV(Udmurtia/338Cg/92)__Z30708.1__N
  source 1..1302: mol_type = other RNA
atgagcgacctgaccgatatccaggaggaaattacaagacacgagcaacagctcgtggtcgccaggcagaagctcaaagacgctgaacgggcagttgaggtggatcccgacgatgtaaacaagaatactctgcaggcccgccaacagacggtgtccgcgttggaagacaaattagctgattacaagcgacgtatggccgactctgtctcaagaaagaagatggataccaagcctacagacccaactggcatagagccggatgaccatctgaaagagaggagtagcccccggtatgggaacgtgctagatgttaatgcaatcgacattgaggaaccttccggacagaccgccgactggtacacaatcggtgtgtatgtcattggcttcaccatcccaataatcctcaaggctctgtacatgctttctactcgcgggagacagacaattaaagaaaacaagggaaccaggatccggtttaaagatgacacgtcgttcgaggatattaatggcatccgccgacccaagcacctgtatgtgtcaatgcctactgcacaaagcaccatgaaggccgaggaattgacaccaggtagatttaggactatagtatgcgggcttttccccacccagattcaggttcggaacatcatgagtcctgtgatgggagtcattggcttttccttctttgtgaaagactggccagagcgtatccgcgatttcatggaaaaggagtgtccgtttatcaaacccgaagtgaagcctggcacaccagctcaggagattgagttcctgaaaagaaatagggtctactttatgacccggcaagacgttctggataagaaccatgtggccgacatagataaactcatcgactatgcggcatctggggatcccacgagccctgacgacattgaatccccaaatgccccctgggtattcgcttgcgccccggatcgatgtcctcccacttgcatctacgtggcaggaatggctgagttaggtgcctttttctcaatactgcaggacatgcgcaacacaattatggcgagtaagaccgtcggcactgccgaagagaaacttaaaaagaaaagctctttctaccagtcctatttgagaaggacacaatcaatggggatccagctggatcagcggatcattctactctacatgctggaatggggaaaggagatggtggaccactttcatcttggcgatgacatggatccagagctgcgcggtttggcacagagcctcatcgaccaaaaagttaaggaaattagtaatcaggagcctctgaagatatga

SEQ ID NO: 5844 - RNA, 1302 nt, synthetic construct
  misc_feature 1..1302: note = derived and/or modified CDS sequence (opt3) from PUUV(Udmurtia/444Cg/88)__Z30706.1__N
  source 1..1302: mol_type = other RNA
atgagcgacctgaccgatatccaggaggaaattacaagacacgagcaacagctcgtggtcgccaggcagaaacttaaagacgctgaacgggcagttgaggtggatcccgacgatgtaaacaagaatactctgcaggcccgccaacagacggtgtccgcgttggaagacaaattagctgattacaagcgacgtatggccgacgcagtctctagaaagaagatggataccaagcctacagacccaactggcatagagccggatgaccatctgaaagagaggtcaagtctacggtatgggaacgtgctcgatgttaatgccatcgacattgaggaacccagcggacagaccgctgactggtacacaatcggtgtgtatgtcattggcttcaccatccctataatcctgaaggcactttacatgctgtccactcgcgggagacagacagtgaaagaaaacaagggaaccaggattcggtttaaagatgacacgtctttcgaggatatcaatggcattcgccgaccaaagcacttgtatgtatcgatgcccactgcccaatcaaccatgaaggctgaggaactcacacctggtagatttaggactatcgtttgcgggctgttcccaacccagatacaggtgcggaacattatgagccccgtcatgggagtgatcggctttagtttctttgtgaaagactggcctgagcgtattcgcgatttcatggaaaaggagtgtccatttatcaaaccggaagtcaagcccggcacccctgcccaggagatcgagttcctgaaaagaaatagggtttactttatgacacggcaagacgtgctcgataagaaccatgtagcggacattgataaattaatagactatgcagcctccggggatccaacgtctcccgacgacatcgaaagccctaatgctccatgggtgttcgcctgcgcacccgatcgatgtccgcctacttgcatttacgtcgctggaatggccgagctgggtgcgtttttctccatccttcaggacatgcgcaacacaataatggcctcaaagaccgtgggcactgcagaagagaagttgaaaaagaaaagtagcttctaccagtcttatctgagaaggacacaatccatggggattcagctagatcagcggatcatcctcctgtacatgcttgaatggggaaaggagatggttgaccactttcatctgggcgatgacatggatcccgagttgcgcggtctcgctcagtcactgattgaccaaaaagtgaaggaaatcagcaatcaggagccattaaagatttga

SEQ ID NO: 5845 - RNA, 1302 nt, synthetic construct
  misc_feature 1..1302: note = derived and/or modified CDS sequence (opt3) from PUUV(Udmurtia/894Cg/91)__Z21497.1__N
  source 1..1302: mol_type = other RNA
atgagcgacctgaccgatatccaggaggaaattacaagacacgagcaacagctcgtggtcgccaggcagaaacttaaagacgctgaacgggcagttgaggtggatcccgacgatgtaaacaagaatactctgcaggcccgccaacagacggtgtccgcgttggaagacaaattagctgattacaagcgacgtatggccgacgcagtctctagaaagaagatggataccaagcctacagacccaactggcatagagccggatgaccatctgaaagagaggtcaagtctacggtatgggaacgtgctcgatgttaatgccatcgacattgaggaacccagcggacagaccgctgactggtacacaatcggtgtgtatgtcattggcttcaccatccctataatcctgaaggcactttacatgctgtccactcgcgggagacagacagtgaaagaaaacaagggaaccaggattcggtttaaagatgacacgtctttcgaggatatcaatggcattcgccgaccaaagcacttgtatgtatcgatgcccactgcccaatcaaccatgaaggctgaggaactcacacctggtagatttaggactatcgtttgcgggctgttcccaacccagatacaggtgcggaacattatgagccccgtcatgggagtgatcggctttagtttctttgtgaaagactggcctgagcgtattcgcgatttcatggaaaaggagtgtccatttatcaaaccggaagtcaagcccggcacccctgcccaggagatcgagttcctgaaaagaaatagggtttactttatgacacggcaagacgtgctcgataagaaccatgtagcggacattgataaattaatagactatgcagcctccggggatccaacgtctcccgacgacatcgaaagccctaatgctccatgggtgttcgcctgcgcacccgatcgatgtccgcctacttgcatttacgtcgtgggaatggctgagctgggtgcctttttctccatccttcaggacatgcgcaacacaataatggcgtcaaagaccgttggcactgccgaagagaagttgaaaaagaaaagtagcttctaccagtcttatctgagaaggacacaatccatggggattcagctagatcagcggatcatcctcctgtacatgcttgaatggggaaaggagatggtggaccactttcatctgggcgatgacatggatcccgagttgcgcggtctcgcacagtcactgattgaccaaaaagtcaaggaaatcagcaatcaggagccattaaagatttga

SEQ ID NO: 5846 - RNA, 1302 nt, synthetic construct
  misc_feature 1..1302: note = derived and/or modified CDS sequence (opt3) from PUUV(Fusong-Cr-247)__EF442087.1__N
  source 1..1302: mol_type = other RNA
atgagcgacctgaaggatatccaggaggacattgccagacacgaacaacagctcgtggtcgctaggcagaaacttcgggatgcagagaaggccgttgaaatggaccccgatgacgtgaacaataacaccctgcaggcgcgccaacagacagtatccgctttggaggataaaatagccgacttcaagcgacgtatggcagatatcgtgtctaggaaaaagatggacactaagcctgccgatccaacgggcattgaaccggacgatcatttaaaagagagatcaagtctgcggtacgggaatgtcctagacgtgaacgctatcgacattgaggaacccagcggacagaccgcagattggtatacaatcggtgtttacataatcggctttactctccctattatcctgaaggccctttatatgctgtccacccgcgggagacagacagtgaaagagaataagggaaccaggattcggttcaaagacgatacttcttttgaagacgtcaacggcatccgccgaccaaagcacttgtacgtgtcgatgcccacagctcaatcaaccatgaaggccgaggagctcacgcctggtagattcaggactatagtatgcgggctgtttccaacccagattcaggttcggaatacaatgagccccgtgatgggagtcatcggcttctcctttttcgcgaaagattggcctgaccgtattaaggaatttatggagaaagaatgtccattcatcaagccggaggtgaaacccggcactcctgcaaaggaagtggagatcctgaaacgcaacaagatttattttatgcagagacaagatgtcctcgacaagaatcatgttccagatatagacaaattaatcgattacgccgctagtggggaccccacctctcctgagaacattgacagcccaaatgccccctgggtgttcgcatgcgctccggataggtgtcctcccacatgcatctatgtagccggaatggcggaactgggtgcctttttctccatacttcaggacatgcggaacaccattatggcatcaaagacggtgggcactgctgaggaaaaattgaagaaaaagagtagcttctaccagtcttacctgcgacgcacacaatccatggggatccagctagatcagagaatcattctcctgtatatgcttgagtggggaaaggaaatggtcgaccactttcatctgggcgatgacatggatccagagttgaggtcactcgcccaggctctgatcgaccaaaaagtgaaggagattagcaatcaggaacctttaaaaatatga

SEQ ID NO: 5847 - RNA, 1302 nt, synthetic construct
  misc_feature 1..1302: note = derived and/or modified CDS sequence (opt3) from MUV(11-4)__JX046484.1__N
  source 1..1302: mol_type = other RNA
atgagcgacctgaaggagatccaggaagatattgccagacacgagcaacagctcgtggtcgctaggcagaaacttcgggacgcagaaaaggccgttgaggtggatcccgacgatgtaaacaaaaataccctgcaggcgcgccaacagacagtgtccgctttggaagacaagttagccgatttcaaacgacagatggcagactttgtctctcgtaagaagatggatactaaacctacggacccaaccggcatagagccggatgaccatctgaaggagagatcaagtctaaggtacgggaacgtgctcgatgttaatgccatcgacattgaggaacccagcggacagacagctgactggtatactatcggtgtgtacattatcggcttcaccctgcctatagtccttaaagcactgtatatgttgtccacacgggggcgccaaaccgtgaaggaaaacaaaggaactagaatcaggtttaaggatgacacatctttcgaggatattaatggcatccggcgcccaaagcacctctacgtatcgatgcccaccgcccagtcaacgatgaaagctgaggaactgactcctggtcgatttagaaccattgtttgcgggctgttcccaacacagatccaggtgaggaacataatgagccccgtcatgggagtgattggctttagtttctttgtgaaggactgggccgatcggatcaaagagttcatggaaaaggagtgtccttttattaaaccagaaccgaagcccggcactcctgcgtccgaggtcgagttcctcaaacgtaataagatctattttatgtctcgccaagacgttttagataagaaccatgtgccagacatcgataaactgattgactacgcagccagcggggatcccacctcccctgacaatatagaagacccaaacgctccctgggtattctcatgcgccccggatagatgtcctcccacatgcctttatgtggcaggaatggctgagttgggtgccttctttagtatcctgcaggacatgaggaataccattatggcgagcaagacggtcggcactgccgaagagaaactaaagaaaaagtcttccttctaccagtcatacctccggcgaacacaaagcatggggatccagctggatcagcgcataattcttctgtatatgttggaatggggaaaggagatggtggaccactttcatctcggcgatgacatggatccagagctgagaaccttagcacaggctctgatcgaccaaaaagttaaggaaatcagtaaccaggagcctctcaaaatttga

SEQ ID NO: 5848 - RNA, 1302 nt, synthetic construct
  misc_feature 1..1302: note = derived and/or modified CDS sequence (opt3) from MUV(00-18)__DQ138128.1__N
  source 1..1302: mol_type = other RNA
atgagcgacctgaaggagatccaggaagatattgccagacacgagcaacagctcgtggtcgctaggcagaaacttcgggacgcagaaaaggccgttgaggtggatcccgacgatgtaaacaaaaataccctgcaggcgcgccaacagacagtgtccgctttggaagacaagttagccgatttcaaacgacagatggcagactttgtctctcgtaagaagatggatactaaacctacggacccaaccggcatagagccggatgaccatctgaaggagagatcaagtctaaggtacgggaacgtgctcgatgttaatgccatcgacattgaagaacccagcggacagacagctgactggtatactatcggtgtgtacgtcattggcttcaccctgcctatcgtgcttaaagcactgtatatgttgtccacacgggggcgccaaaccgtaaaggaaaacaaaggaactagaataaggtttaaggatgacacatctttcgaggatatcaatggcattcggcgcccaaagcacctctacgtttcgatgcccaccgcccagtcaacgatgaaagctgaggaactgactcctggtcgatttagaaccatcgtgtgcgggctgttcccaacacagattcaggtcaggaacatcatgagccccgtgatgggagtgataggctttagtttctttgtcaaggactgggttgagcggattaaagagttcatggagaaggaatgtccttttatcaaaccagagccgaagcccggcactcctgcctccgaggtggagttcctcaaacgtaataagatttattttatgaaccgccaagatgtattagacaagaatcatgtgccagatatcgacaaactgatcgattacgcggcatctggggaccccaccagccctgataacattgaagacccaaatgccccctgggtcttctcctgcgctccggacagatgtcctcccacatgcctttatgtggccggaatggcagaattgggtgctttcttttcaatactgcaggatatgaggaacaccatcatggccagtaagacggttggcactgcggaggaaaaactaaagaaaaagagctctttctaccagtcctacctccggcgaacacaatcaatggggattcagctggaccagcgcatcatacttctgtatatgttggagtggggaaaggagatggtggatcactttcatctcggcgacgatatggacccagaactgagaaccttagcccaggcactgattgatcaaaaagtcaaggagatcagcaatcaggaacctctcaaaatctga

SEQ ID NO: 5849 - RNA, 1302 nt, synthetic construct
  misc_feature 1..1302: note = derived and/or modified CDS sequence (opt3) from MUV(11-1)__JX028273.1__N
  source 1..1302: mol_type = other RNA
atgagcgacctgaaggagatccaggaagatattgccagacacgagcaacagctcgtggtcgctaggcagaaacttcgggacgcagaaaaggccgttgaggtggatcccgacgatgtaaacaaaaataccctgcaggcgcgccaacagacagtgtccgctttggaagacaagttagccgatttcaaacgacagatggcagactttgtctctcgtaagaagatggatactaaacctacggacccaaccggcatagagccggatgaccatctgaaggagagatcaagtctaaggtacgggaacgtgctcgatgttaatgccatcgacattgaggaacccagcggacagacagctgactggtatactatcggtgtgtacattatcggcttcaccctgcctatagtccttaaagcactgtatatgttgtccacacgggggcgccaaaccgtgaaggaaaacaaaggaactagaatcaggtttaaggatgacacatctttcgaggatattaatggcatccggcgcccaaagcacctctacgtatcgatgcccaccgcccagtcaacgatgaaagctgaggaactgactcctggtcgatttagaaccattgtttgcgggctgttcccaacacagatccaggtgaggaacataatgagccccgtcatgggagtgattggctttagtttctttgtgaaggactgggccgatcggatcaaagagttcatggaaaaggagtgtccttttattaaaccagaaccgaagcccggcactcctgcgtccgagatcgagttcctcaaacgtaataagatctattttatgtctcgccaagacgtcttagataagaaccatgttccagacattgataaactgatagactacgcagccagcggggatcccacctcccctgacaatatcgaagacccaaacgctccctgggtgttctcatgcgccccggatagatgtcctcccacatgcctttatgtagcaggaatggctgagttgggtgccttctttagtattctgcaggacatgaggaataccatcatggcgagcaagacggtgggcactgccgaagagaaactaaagaaaaagtcttccttctaccagtcatacctccggcgaacacaaagcatggggatacagctggatcagcgcattatccttctgtatatgttggaatggggaaaggagatggtcgaccactttcatctcggcgatgacatggatccagagctgagaaccttagcacaggctctgatcgaccaaaaagtgaaggaaattagtaaccaggagcctctcaaaatctga

SEQ ID NO: 5850 - RNA, 1302 nt, synthetic construct
  misc_feature 1..1302: note = derived and/or modified CDS sequence (opt3) from MUV(96-1)__DQ138133.1__N
  source 1..1302: mol_type = other RNA
atgagcgacctgaaggagatccaggaagatattgccagacacgagcaacagctcgtggtcgctaggcagaaacttcgggacgcagaaaaggccgttgaggtggatcccgacgatgtaaacaaaaataccctgcaggcgcgccaacagacagtgtccgctttggaagacaagttagccgatttcaaacgacagatggcagactttgtctctcgtaagaagatggatactaaacctacggacccaaccggcatagagccggatgaccatctgaaggagagatcaagtctaaggtacgggaacgtgctcgatgttaatgccatcgacattgaggaacccagcggacagacagctgactggtatactatcggtgtgtacgtcattggcttcaccctgcctatcgtgcttaaagcactgtatatgttgtccacacgggggcgccaaaccgtaaaggaaaacaaaggaactagaataaggtttaaggatgacacatctttcgaggatatcaatggcattcggcgcccaaagcacctctacgtttcgatgcccaccgcccagtcaacgatgaaagctgaggaactgactcctggtcgatttagaaccatcgtgtgcgggctgttcccaacacagattcaggtcaggaacatcatgagccccgtgatgggagtgatacggtttagtttcctcgtcaaggactggtccgagaaaattaaggaatttatggagaaagaatgtcctttcatcaagccagagccgaaacccggcactcctgcctctgagattgaatttttaaagcgtaataagatctatttcatgaaccgccaagatgttctggacaaaaatcatgtgccagatatcgacaaacttattgattacgcggcaagcggcgaccccacctcccctgataacatagaggccccaaatgctccctgggtattttcatgcgccccggacagatgtcctcccacatgcttgtatgtggcagggatggctgaactgggagccttcttcagtatcctacaggacatgaggaacaccattatggcgagcaagacggtcggtactgccgaggaaaagctcaaaaagaagtcttccttttaccagtcatacctgcggcgaacacaaagcatgggcatccagcttgatcagcgcataattctgttgtatatgctcgagtgggggaaagagatggtggaccacttccatctgggagatgacatggatccagaattaagaaccctggcacaggctctcatcgaccaaaaggttaaagagatcagtaatcaggaacctcttaagatttga

SEQ ID NO: 5851 - RNA, 1302 nt, synthetic construct
  misc_feature 1..1302: note = derived and/or modified CDS sequence (opt3) from MUV(99-28)__DQ138142.1__N
  source 1..1302: mol_type = other RNA
atgagcgacctgaaggagatccaggaagatattgccagacacgagcaacagctcgtggtcgctaggcagaaacttcgggacgcagaaaaggccgttgaggtggatcccgacgatgtaaacaaaaataccctgcaggcgcgccaacagacagtgtccgctttggaagacaagttagccgatttcaaacgacagatggcagactttgtctctcgtaagaagatggatactaaacctacggacccaaccggcatagagccggatgaccatctgaaggagagatcaagtctaaggtacgggaacgtgctcgatgttaatgccatcgacattgaagaacccagcggacagacagctgactggtatactatcggtgtgtacgtcattggcttcaccctgcctatcgtgcttaaagcactgtatatgttgtccacacgggggcgccaaaccgtaaaggaaaacaaaggaactagaataaggtttaaggatgacacatctttcgaggatatcaatggcattcggtcgccaaagcacctctacgtttcaatgcccaccgcccagagcacgatgaaagctgaggaactgactcctggtcgctttcgaaccatcgtgtgcgggctgttcccaacacagattcaggtcagaaacatcatgagtcccgtgatgggagtgataggcttttccttctttgtcaaggactgggttgagaggattaaagagttcatggagaaggaatgtccttttatcaaaccagagccgaagcccggcactcctgcctctgaggtggagttcctcaaacggaataagatttattttatgaaccgtcaagatgtattagacaagaatcatgtgccagatatcgacaaactgatcgattacgcggcaagcggggaccccacctcccctgataacattgaagacccaaatgccccctgggtcttctcatgcgctccggaccgctgtcctcccacatgcctttatgtggccggaatggcagaattgggtgctttctttagtatactgcaggatatgagaaacaccatcatggccagcaagacggttggcactgcggaggaaaaactaaagaaaaagtcttccttctaccagtcatacctcaggcggacacaaagcatggggattcagctggaccagcgaatcatacttctgtatatgttggagtggggaaaggagatggtggatcactttcatctcggcgacgatatggacccagaactgcgcaccttagcccaggcactgattgatcaaaaagtcaaggagatcagtaatcaggaacctctcaaaatctga

SEQ ID NO: 5852 - RNA, 1290 nt, synthetic construct
  misc_feature 1..1290: note = derived and/or modified CDS sequence (opt3) from SANGV(SA14)__NC_034526.1__N
  source 1..1290: mol_type = other RNA
atggccaccctggaggaaatccagaaggagattaacatacacgaaggccaactcatcattgctaaacagaaggtgaaagacgcagagaagcagtacgaaaaagatcccgacgatcttaataagagagccctgagcgacagggaggggatcgcgcattccattcagtctaagatcgatgagttgcggcgccaattagctgaccgagtcgccgcaggacgtaacctgggtcaggaaagagatcctacaggcgttgagccaggggaccacctaagggaaaaatcaatgctcagttatggaaatgtgatagatctgaaccatcttgacatcgatgagccgactggccagacggccgactggctgagcattgtaatctacttgacctccttcgtggtccccattctcctgaaggctctgtatatgctcacaactcggggtcgccagaccacaaaagataataaggggatgagaatcaggtttaaagacgactcttcgttcgaggatgtgaacggaatacggaagcctaagcacttatttctgtcaatgccaaatgcacaaagcagtatgaaagccgaagagattacccccggccgcttccgaactgctgtttgcggcctttaccctgcccagatcaaggcgagaaacatggtgtccccagtcatgtctgtgattgggtttatcacattggcaagggactggaccgaacggatcgagaattggctggatcagccctgtaaattcatgagcgaaccttcccagacgtcactacaaaagggaccagccactaaccgtgactatctcaatcagcgccaggctagtctggcccaaatggagaccaaagaggcacaggctgtaagacagcaggccgttgatgcgggttgcaaccttgtggaccatattgatagcccgtcttccatatgggtctttgccggcgcacccgacaggtgtcctccaacatgcctgttcatctcagggatggctgaattgggagcctttttcagcattctccaagatatgcggaatactatcatggctagtaagaccgtgggcacatctgaggaaaaactgcgaaagaagtccagcttttaccagtcgtatttacgcagaacccagtctatgggtatacagctggaccaaaggattatcatcatgttcatggtggagtgggggaaagaagccgtcgatggatttcacctcggcgacgacatggatcccgagcttcggtccttcgcacaggccctgattgaccagaaggttaaagagatctcaaaccaggaacctttgaagatttga

SEQ ID NO: 5853 - RNA, 1290 nt, synthetic construct
  misc_feature 1..1290: note = derived and/or modified CDS sequence (opt3) from SANGV(SA22)__JQ082303.1__N
  source 1..1290: mol_type = other RNA
atggccaccctggaggaaatccagaaggagattaacatacacgaaggccaactcatcattgctaaacagaaggtgaaagacgcagagaagcagtacgaaaaagatcccgacgatcttaataagagagccctgagcgacagggaggggatcgcgcattccattcagtctaagatcgatgagttgcggcgccaattagctgaccgagtcgccgcaggacgtaacctgggtcaggaaagagatcctacaggcgttgagccaggggaccacctaagggaaaaatcaatgctcagttatggaaatgtgatagatctgaaccatcttgacatcgatgagccgactggccagacggccgactggctgagcattgtaatctacttgacctccttcgtggtccccattctcctgaaggctctgtatatgctcacaactcggggtcgccagaccacaaaagataataaggggatgagaatcaggtttaaagacgactcttcgttcgaggatgtgaacggaatacggaagcctaagcacttatttctgtcaatgccaaatgcacaaagcagtatgaaagccgaagagattacccccggccgcttccgaactgctgtttgcggcctttaccctgcccagatcaaggcgagaaacatggtgtccccagtcatgtctgtgattgggtttatcacattggcaagggactggaccgaacggatcgagaattggctggatcagccctgtaaattcatgagcgaaccttcccagacgtcactacaaaagggaccagccactaaccgtgactatctcaatcagcgccaggctagtctggcccaaatggagaccaaagaggcacaggctgtaagacagcaggccgttgatgcgggttgcaaccttgtggaccatattgatagcccgtcttccatatgggtctttgccggcgcacccgacaggtgtcctccaacatgcctgttcatctcagggatggctgaattgggagcctttttcagcattctccaagatatgcggaatactatcatggctagtaagaccgtgggcacatctgaggaaaaactgcgaaagaagtccagcttttaccagtcgtatttacgcagaacccagtctatgggtatacagctggaccaaaggattatcatcatgttcatggtggagtgggggaaagaagtcgttgatggatttcacctcggcgacgacatggatcccgagcttcggtccttcgcccaggcactgattgaccagaaggtgaaagagatctcaaaccaggaacctttgaagatttga

SEQ ID NO: 5854 - RNA, 1290 nt, synthetic construct
  misc_feature 1..1290: note = derived and/or modified CDS sequence (opt3) from SEOV(L99)__AF288299.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcggacacttcatgaccgcgagtccgttgcggcttctatccagtcaaaaattgatgagctgaagcgacaattggccgaccgtatcgcagccgggaagaatattggacaggatagagaccctactggtgtggaaccaggcgatcacttaaaagagaggagtgctctgagctatgggaacacgctagacctcaattccctggatatcgacgaaccgaccggacagacagcagattggcttactataatcgtatacctgacctctttcgtggtccccattatcttgaaggccctctatatgctgacaacccggggccgccagacttcgaaagacaacaagggtatgagaattaggtttaaagacgattcaagctacgaggacgtgaatgggatccggaagcctaagcatctgtatgttagtatgccaaacgctcaatcctctatgaaagccgaggaaataacacccggacgcttccgaaccgcggtgtgcggcctctaccctgcacagattaaggccagaaatatggtcagcccagtgatgtccgtagttggctttttagctctggccaaagattggacgtcaaggatcgaggaatggcttggggcaccctgtaagttcatggctgagagtcctattgccggtagcttgtctggaaacccagtgaatcgggactatatccgtcagcgccagggcgcgctggccgggatggaaccgaaagagtttcaagcactaagacagcacgctaaggatgccggatgcactctcgtcgagcatatcgaatccccctcaagcatttgggtgttcgctggcgcccctgacaggtgtccacctacctgcctgtttgtgggtgggatggcagagcttggagccttctttagtatactgcaggatatgcggaacacaatcatggcttctaaaactgtcggcaccgcggacgaaaagttgcgaaagaaatccagcttctaccaatcgtacctccgcagaacacagtctatgggcattcagctggatcagaggatcatagttatgtttatggtggcatgggggaaggaggccgtatataatttccacttaggagacgatatggaccccgaactgcggtccctcgctcaaattcttatcgaccagaaagtgaaggagatctcaaaccaggagccaatgaaactgtga

SEQ ID NO: 5855 - RNA, 1290 nt, synthetic construct
  misc_feature 1..1290: note = derived and/or modified CDS sequence (opt3) from SEOV(SG42/2011)__KY807171.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggtctacaataatcgtataccttacttcgttcgtggtccccattatcctgaaggctttgtatatgctcaccacacggggccgccagacctcaaaagacaacaagggtatgagaattaggtttaaagacgatagcagttacgaggacgtgaatgggatccggaagcctaagcatctgtatgtttccatgccaaacgcccaatctagcatgaaagcggaggaaataactcccggacgcttccgaacagcagtgtgcggcctgtaccctgcccagattaaggctagaaatatggtctccccagtgatgtcagtagttggctttctcgccttagcaaaagattggagtagcaggatcgaggaatggctgggggctccctgtaagttcatggccgagtctcctattgcgggatccctttcaggtaacccagtgaatcgggactatatccgtcagcgccagggcgccttggcagggatggaaccgaaagagtttcaagctctgagacagcacagcaaggatgccggatgcaccctagtcgagcatatcgaaagtccctcttccatttgggtgttcgctggcgcccctgacaggtgtccacccacgtgcctctttgtgggtgggatggcagagctgggagccttctttagcatacttcaggatatgcggaacactatcatggcttcgaaaaccgtcggcacagcggacgaaaagctgcgaaagaaatcttccttctaccaatcatacttgcgcagaactcagagtatgggcattcagctcgatcagaggatcatagttatgtttatggtggcatgggggaaggaggccgtagacaatttccacctgggagatgacatggaccctgaattacggagcctggctcaaattctcatcgatcagaaagtgaaggagatctccaaccaggagccaatgaaactttga

SEQ ID NO: 5856 - RNA, 1290 nt, synthetic construct
  misc_feature 1..1290: note = derived and/or modified CDS sequence (opt3) from SEOV(XJ2/2011)__KY807169.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggtcgcgccagacctcaaaagacaacaagggcatgagaattaggtttaaagacgatagcagttacgaggacgtgaatggtatccggaagcctaagcatctgtatgtttccatgccaaacgcccaatctagcatgcgcgcggaggaaataactcccgggcgattcagaacagcagtgtgcggactctaccctgcccagattaaagctaggaatatggtctccccagtgatgtcagtagttggctttttagccctggcaaaggattggaccagtcggatcgaggaatggcttggcgctccctgtaaattcatggccgagagccctattgcggggtctttgtccggaaacccagtgaatcgtgactatatccgccagagacagggtgccctggcaggctgggaaccgaaggagtttcaagctctaaggcagcactcaaaagatgccgggtgcacgctcgtcgagcatatcgaaagccccagttctatttgggtgttcgctggagcccctgaccggtgtccacccacttgcctgtttgtgggcggtatggcagagcttggggccttcttttccatactgcaggatatgcgaaacaccatcatggctagcaagacagtcggaactgcggacgaaaaattgcgcaagaagtcgtctttctaccaatcctacctcagaaggacccagtcaatgggcattcagctggatcagcggatcatagttatgtttatggtggcatggggcaaagaggccgtagacaatttccacttaggggatgacatggaccctgaactgcgcagtctcgctcaaattcttatcgatcagaaggtgaaagagatcagcaaccaggagccaatgaagctgtga

SEQ ID NO: 5857 - RNA, 1290 nt, synthetic construct
  misc_feature 1..1290: note = derived and/or modified CDS sequence (opt3) from SEOV(XJ5/2011)__KY807170.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggaaacccagtgaatcgggactatatccgtcagcgccagggcgccctggcagggatggaaccgaaagagtttcaagctctaagacagcaccccaaggatgccggatgcacgctcgtcgagcatatcgaatccccttcaagcatttgggtgttcgctggcgccccagacaggtgtccccctacttgcctgtttgtgggtgggatggcagagcttggagccttctttagtatactgcaggatatgcggaacaccatcatggcttctaaaacagtctccactgcggacgaaaagttgcgaaagaaaagctcgttctaccaatcttacctccgcagaacccagtccatgggcattcagctggatcagaggatcatagttatgtttatggtggcatggggcaaggaggccgtagacaatttccacttaggggatgacatggacccagaactgcggtcactcgctcaaattcttatcgatcagaaagtgaaggagatcagtaaccaggagcccatgaaactgtga

SEQ ID NO: 5858 - RNA, 1290 nt, synthetic construct
  misc_feature 1..1290: note = derived and/or modified CDS sequence (opt3) from SEOV(10-134)__JF693882.2__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtgttgcccattatcctcaaggctctgtatatgctgaccacacggggccgccagacctcgaaagacaacaagggtatgagaattaggtttaaagacgattcaagctacgaggacgtcaatgggatccggaagcctaagcatctctatgtgagtatgccaaacgcccaatcctctatgaaagcggaggaaataactcccggacgcttccgaacagcagtttgcggcttataccctgcccagattaaggctagaaatatggtgagcccagtcatgtccgtggtaggctttctggcccttgcaaaagattggacctcaaggatcgaggaatggttgggggctccctgtaagttcatggccgagagtcctattgcgggaagcctgtctggtaacccagttaatcgggactatatccgtcagcgccagggcgccctagcagggatggaaccgaaagagtttcaagctctcagacagcactccaaggatgccggatgcacgctggtggagcatatcgaatcacccagcagtatttgggtcttcgctggcgcccctgacaggtgtccacccacttgcctttttgtgggtgggatggcagagctgggagccttcttttctatattgcaggatatgcggaacaccatcatggcttccaaaacagtgggcactgcggacgaaaagctccgaaagaaaagctcgttctaccaatcttacctgcgcagaacccagtccatgggcattcagttagatcagaggatcatagtcatgtttatggttgcatgggggaaggaggccgtggacaatttccacctgggagatgacatggaccctgaactccggtcacttgctcaaattctgatcgatcagaaagtaaaggagatcagtaaccaggagccaatgaaattgtga

SEQ ID NO: 5859 - RNA, 1290 nt, synthetic construct
  misc_feature 1..1290: note = derived and/or modified CDS sequence (opt3) from SEOV(DPRK08)__JX853575.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggaaacccagtgaatcgggactatatccgtcagcgccagggcgccctggcagggatggaaccgaaagagtttcaagctctaagacagcacgccaaggatgctggatgcacgctcgtcgagcatatcgaatccccctcaagcatttgggtgttcgccggcgcacctgacaggtgtccacccacttgcctgtttgtgggtgggatggccgagcttggagctttctttagtatactgcaggatatgcggaacaccatcatggcgtctaaaacagtcggcactgcagacgaaaagttgcgaaagaaatccagcttctaccaatcgtacctccgcagaacccagtctatgggcattcagctggatcagaggatcatagttatgtttatggtggcctgggggaaggaggctgtagacaatttccacttaggagatgacatggaccctgaactgcggtccctcgcccaaattcttatcgatcagaaagtgaaggagatctcaaaccaggagccaatgaaactgtga

SEQ ID NO: 5860 - RNA, 1290 nt, synthetic construct
  misc_feature 1..1290: note = derived and/or modified CDS sequence (opt3) from SEOV(Fj372/2013)__KP645198.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggatccccagtgaaccgggactatatccgtcagcgccagggcgccctggcagggatggaaccgaaagagtttcaagctctaagacagcacgccaaggatgctggatgcacgctcgtcgagcatatcgaatcacccagcagtatttgggtgttcgccggcgcacctgacaggtgtccacccacttgcctgtttgtgggtgggatggccgagcttggagctttcttttctatactgcaggatatgcggaataccatcatggcgtccaaaacagtcggcactgcagacgaaaagttgcgaaagaaaagctcgttctaccaatcttacctccgcagaacccagtccatgggcattcagctggatcagaggatcatagttatgtttatggtggcctgggggaaggaggctgtagacaacttccacttaggagatgacatggaccctgaactgcggtcactcgcccaaattcttatcgatcagaaagtgaaggagatcagtaatcaggagccaatgaaactgtga

SEQ ID NO: 5861 - RNA, 1290 nt, synthetic construct
  misc_feature 1..1290: note = derived and/or modified CDS sequence (opt3) from SEOV(HeB38)__JN377553.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgaaaattagatttaaggacgattcaagctacgaggacgtgaatgggatcaggaagcctaaacatctgtatgttagtatgccaaacgcccaatcctctatgaaggcggaggaaataactcccggacggttccgcacagcagtgtgcggcctctaccctgcccagattaaagctcgaaatatggtcagcccagtgatgtccgtagttggctttttagccctggcaaaggattggacctcaagaatcgaggaatggcttggggctccctgtaaattcatggccgagagtcctattgcgggtagcttgtctggaaacccagtgaatagggactatatccggcagcgtcagggcgccctggcagggatggaaccgaaggagtttcaagctctacgccagcactccaaagatgccggatgcacgctcgtcgagcatatcgaatcacccagcagtatttgggtgttcgctggcgcccctgacagatgtccacccacttgcctgtttgtgggtgggatggcagagcttggagccttcttttctatactgcaggatatgaggaacaccatcatggcttccaagacagtcggcactgcggacgaaaagttgcggaaaaagagccctttctaccaatcgtacctccgacgcacccagtctatgggcattcagctggatcagagaatcatagttatgtttatggtggcatgggggaaagaggccgtagacaatttccacttaggagatgacatggacccagaactgaggggtctcgctcaaattcttatcgatcagaaggtgaaagagatctccaaccaggagcccatgaagctgtga

SEQ ID NO: 5862 - RNA, 1290 nt, synthetic construct
  misc_feature 1..1290: note = derived and/or modified CDS sequence (opt3) from SEOV(JiangxiXinjianRn-07-2011)__KP859511.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggaaacccagtgaatcgggactatatccgtcagcgccagggcgccctggcagggatggaaccgaaagagtttcaagctctaagacagcactccaaggatgccggatgcacgctcgtcgagcatatcgaatcacccagcagtatttgggtgttcgctggcgcccctgacaggtgtccacccacttgcctgtttgtgggtgggatggcagagcttggagccttcttttctatactgcaggatatgcggaacaccatcatggcttccaaaacagtcggcactgcggacgaaaagttgcgaaagaaaagctcgttctaccaatcttacctccgcagaacccagtccatgggcattcagctggatcagaggatcatagttatgtttatggtggcatgggggaaggaggccgtagacaatttccacttaggagatgacatggaccctgaactgcggtcactcgctcaaattcttatcgatcagaaagtgaaggagatcagtaaccaggagccaatgaaactgtga

SEQ ID NO: 5863 - RNA, 1290 nt, synthetic construct
  misc_feature 1..1290: note = derived and/or modified CDS sequence (opt3) from SEOV(JiangxiXinjianRn-09-2011)__KP859512.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaattctccatgaaagcggaggaaataactcccggacgctttcgaacagcagtgtgcggcctctaccctgcccagattaaggctagaaatatggtctctccagtgatgagcgtagttggcttcttagccctggcaaaagattggacctccaggatcgaggaatggcttggggctccctgtaagtttatggccgagtcacctattgcgggaagtttgagcggtaacccagtgaatcgggactatatccgtcagcgccagggcgccctggcagggatggaaccgaaagagttccaagctctaagacagcactctaaggatgccggatgcacgctcgtcgagcatatcgaatccccctcaagcatttgggtgtttgctggcgcccctgacaggtgtccacccacttgcctgttcgtgggtgggatggcagagcttggagcctttttcagtatactgcaggatatgcggaacaccatcatggcttctaaaacagtcggcactgcggacgaaaagttgcgaaagaaatccagcttttaccaatcgtacctccgcagaacccagtctatgggcattcagctggatcagaggatcatagttatgttcatggtggcatgggggaaggaggccgtagacaattttcacttaggagatgacatggaccctgaactgcggtccctcgctcaaattcttatcgatcagaaagtgaaggagatctcaaaccaggagccaatgaaactgtga

SEQ ID NO: 5864 - RNA, 1290 nt, synthetic construct
  misc_feature 1..1290: note = derived and/or modified CDS sequence (opt3) from SEOV(Singapore/06(RN41))__GQ274944.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggaaacccagtgaatcgggactatatccgtcagcgccagggcgccctggcagggatggaaccgaaagagtttcaagctctaagacagcactccaaggatgccggatgcacgctcgtcgagcatatcgaatcacccagcagtatttgggtgttcgctggcgcccctgacaggtgtccacccacttgcctgtttgtgggtgggatggcagagcttggagccttcttttctatactgcaggatatgcggaacaccatcatggcttccaaaacagtcggcactgcggacgaaaagttgcgaaagaaaagctcgttctaccaatcttacctccgcagaacccagtccatgggcattcagctggatcagaggatcatagttatgtttatggtggcatgggggaaggaggccgtagacaatttccacttaggagatgacatggaccctgaactgcggggtctcgctcaaattcttatcgatcagaaagtgaaggagatctcaaaccaggagccaatgaaactgtga

SEQ ID NO: 5865 - RNA, 1290 nt, synthetic construct
  misc_feature 1..1290: note = derived and/or modified CDS sequence (opt3) from SEOV(YaluRiver12)__HQ611980.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccggggacctcaacaagcgggcgcttcatgatcgcgagtccgttgctgcctctatccagtcaaaaattgacgagctgaagcgacaattggcagatcgtatcgccgctggaaagaatattggtcaggacagagatcctacaggcgtggaaccaggggaccacttaaaagagaggagtgcactgagctatggaaacactctagatctcaattccctggacatcgatgaaccgacgggccagaccgccgactggcttacaataatcgtatacctgacttctttcgtggtccccattatcttgaaggctctctatatgctgaccacacggggtcgccagacctcgaaagattcaaaggggatgagaattaggtttaaagacgacagcagttacgaggatgtgaacggaatccggaagcctaagcatctgtatgtttccatgccaaatgcccaatctagcatgaaaactgaggaaataacacccggccgcttccgaaccgcggtgtgcggcctctaccctgcacagattaaggccagaaacatggtctccccagtgatgtcagtagttgggtttttagctctggccaaagactggacgagtaggatcgaggaatggcttggagcaccctgtaagttcatggctgagagccctattgccggttctttgtccgaaaatccagtgaaccgggattatatccgtcagcgccagggcgcgctggccgggatggagccgaaagagtttcaagcactaagacagcacgctaaggacgccggatgcactctcgtcgaacatatcgagtcacccagcagtatttgggtgttcgctggcgcccctgataggtgtccacctacctgcctgtttgtgggtgggatggcagaacttggagccttcttttctatactgcaggacatgcggaatacaatcatggcttccaaaactgtcggcaccgcggatgagaagttgcgaaagaaaagctcgttctaccaatcttacctccgcagaacacagtccatgggcattcagctggaccagaggatcatagttatgtttatggtggcatgggggaaggaagccgtagataacttccacttaggagacgatatggaccccgagctgcggtcactcgctcaaattcttatcgaccagaaagtgaaggagatcagtaatcaggaaccaatgaaactgtga

SEQ ID NO: 5866 - RNA, 1290 nt, synthetic construct
  misc_feature 1..1290: note = derived and/or modified CDS sequence (opt3) from SEOV(14D12)__AB618124.1__N
  source 1..1290: mol_type = other RNA
atggccaccatggaggaaatccagaaggagattagcgctcacgaaggccaactggtgatagcaagacagaaagtcaaggacgccgagaaacagtacgaaaaggatcccgacgatctcaacaaaagggcgcttcatgaccgggagtccgttgctgcctctatccagtcaaagattgatgagctgaagcgccaattggcagaccgaatcgccgctgggaaaaatattggacaggatcgtgaccctacaggtgtggaaccaggcgatcacttaaaggagagaagtgcactgagctatgggaacactctagacctcaattccctggatatcgacgaaccgacgggacagaccgccgattggcttacaataatcgtatacctgacttctttcgtggtccccattatcttgaaagctctctatatgctgaccacaaggggccggcagacctcgaaggacaacaaaggtatgcgcattagatttaaggacgattcaagctacgaggacgtgaatgggatcaggaagcctaaacatctgtatgttagtatgccaaacgcccaatcctctatgaaggcggaggaaataactcccggacggttccgcacagcagtgtgcggcctctaccctgcccagattaaagctcgaaatatggtcagcccagtgatgtccgtagttggctttttagccctggcaaaggattggacctcaagaatcgaggaatggcttggggctccctgtaaattcatggccgagagtcctattgcgggtagcttgtctggaaacccagtgaatagggactatatccggcagcgtcagggcgccctggcagggatggaaccgaaggagtttcaagctctacgccagcactccaaagatgccggatgcacgctcgtcgagcatatcgaatcacccagcagtatttgggtgttcgctggcgcccctgacagatgtccacccacttgcctgtttgtgggtgggatggcagagcttggagccttcttttctatactgcaggatatgaggaacaccatcatggcttccaagacagtcggcactgcggacgaaaagttgcggaaaaagagctcgttctaccaatcttacctccgacgcacccagtccatgggcattcagctggatcagagaatcatagttatgtttatggtggcatgggggaaagaggccgtagacaatttccacttaggagatgacatggaccctgaactgaggtcactcgctcaaattcttatcgatcagaaggtgaaagagatcagtaaccaggagccaatgaagctgtga

SEQ ID NO: 5867 - RNA, 1281 nt, synthetic construct
  misc_feature 1..1281: note = derived and/or modified CDS sequence (opt3) from SEOV(19CSG)__AB618114.1__N
  source 1..1281: mol_type = other RNA
atggaggaaatccagagagagattagcgcccacgaaggccaactggtgatagctaggcagaaggtcaaagacgcagagaagcagtacgaaaaagatcccgacgatctcaacaagcgggcccttcatgaccgcgagtccgttgcggcttctatccagtcaaaaattgatgagctgaagcgacaattggccgaccgtatcgcagccgggaagaatattggacaggatagagaccctaccggtgtggaaccaggcgatcacttaaaagagaggagtgctctgagctatgggaacacactagacctcaattccctggatatcgacgaaccgactggacagacggcagattggcttaccataatcgtatacctgacatctttcgtggtccccattatcttgaaggccctctatatgctgactacccggggccgccagacatcgaaagacaacaagggtatgagaattaggtttaaagacgattcaagctacgaggacgtgaatgggatccggaagcctaagcatctgtatgttagtatgccaaacgctcaatcctctatgaaagccgaggaaataacccccggacgcttccgaactgcggtgtgcggcctctaccctgcacagattaaggccagaaatatggtcagcccagtgatgtccgtagttggctttttagctctggccaaagattggacatcaaggatcgaggaatggcttggggcaccctgtaagttcatggctgagagtcctattgccggtagcttgtctggaaacccagtgaatcgggactatatccgtcagcgccagggcgcgctggccgggatggaaccgaaagagtttcaagcactaagacagcactccaaggatgctggatgcaccctcgtcgagcatatcgaatcacccagcagtatttgggtgttcgccggcgctcctgacaggtgtccacccacgtgcctgtttgtgggtgggatggccgagcttggagcattcttttctatactgcaggatatgcggaacactatcatggcctccaaaaccgtcggcacagctgacgaaaagttgcgaaagaaaagctcgttctaccaatcttacctccgcagaactcagtccatgggcattcagctggatcagaggatcatagttatgtttatggtggcgtgggggaaggaggcagtagacaatttccacttaggagatgacatggaccctgaactgcggtcactcgcccaaattcttatcgatcagaaagtgaaggagatcagtaaccaggagccaatgaaactgtga

SEQ ID NO: 5868 - RNA, 1290 nt, synthetic construct
  misc_feature 1..1290: note = derived and/or modified CDS sequence (opt3) from SEOV(93HBX12)__EF192308.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatcggaaagcctaagcatctgtatgttagtatgccaaacgcccaatcctctatgaaagcggaggaaataactcccggccggttccgcacagcagtgtgcggcctctaccctgcccagattaaggctcgaaatatggtcagcccagtgatgtccgtagttgggtttttagccctggcaaaagattggacctcaagaatcgaggaatggcttggagctccctgtaagttcatggccgagagtcctattgcgggtagcttgtctggcaacccagtgaatagggactatatccggcagcgtcagggggccctggcaggaatggaaccgaaagagtttcaagctctacgccagcactccaaggatgccggctgcacgctcgtcgagcatatcgaatcacccagcagtatttgggtgttcgctggtgcccctgacagatgtccacccacttgcctgtttgtcgggggaatggcagagcttggcgccttcttttctatactgcaggatatgaggaacaccatcatggcttccaaaacagtgggcactgcggacgaaaagttgcggaagaaaagctcgttctaccaatcttacctccgacgcacccagtccatggggattcagctggatcagagaatcatagttatgtttatggtggcatggggaaaggaggccgtagacaatttccacttaggtgatgacatggaccctgaactgaggggcctcgctcaaattcttatcgatcagaaagtgaaggagatctcaaaccaggagccaatgaaactgtga

SEQ ID NO: 5869 - RNA, 1290 nt, synthetic construct
  misc_feature 1..1290: note = derived and/or modified CDS sequence (opt3) from SEOV(Cherwell)__KC626089.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcattgccgagagtcctatcgcgggtagcttgtctggaaacccagtgaatcgggactatatccgtcagcgccagggcgccctggcagggatggaaccgaaagagtttcaagctctaagacagcactccaaggatgccggatgcacgctcgtcgagcatattgaatcacccagcagtatatgggtgttcgctggcgcccctgacaggtgtccacccacttgcctgtttgtgggtgggatggcagagcttggagccttcttttctatcctgcaggatatgcggaacaccattatggcttccaaaacagtcggcactgcggacgaaaagttgcgaaagaaaagctcgttctaccaatcttacctccgcagaacccagtccatgggcatccagctggatcagaggataattgttatgtttatggtggcatgggggaaggaggccgtagacaatttccacttaggagatgacatggaccctgaactgcggtcactcgctcaaatccttatcgatcagaaagtgaaggagattagtaaccaggagccaatgaaactgtga

SEQ ID NO: 5870 - RNA, 1290 nt, synthetic construct
  misc_feature 1..1290: note = derived and/or modified CDS sequence (opt3) from SEOV(CixiRf23)__FJ803201.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggaaacccagtgaatcgggactatatccgtcagcgccagggcgccctggcagggatggaaccgaaagagtttcaagctctaagacagcacgccaaggatgctggaaggacgctcgtcgagcatatcgaatccccctcaagcatttgggtgttcgccggcgcacctgaccggtgcccacccacttgtctgtttgtgggtgggatggccgagcttggagctttctttagtatactgcaggatatgcgaaacaccatcatggcgtctaaaacagtcggcactgcagacgaaaagttgcgcaagaaatccagcttctaccaatcgtacctcagaaggacccagtctatgggcattcagctggatcagcggatcatagttatgtttatggtggcctgggggaaggaggctgtagacaatttccacttaggagatgacatggaccctgaactgcgctccctcgcccaaattcttatcgatcagaaagtgaaggagatctcaaaccaggagccaatgaaactgtga

SEQ ID NO: 5871 - RNA, 1290 nt, synthetic construct
  misc_feature 1..1290: note = derived and/or modified CDS sequence (opt3) from SEOV(CixiRf56)__FJ803202.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcggggagcttgtctggtaacccagtgaatcgggactatatccgtcagggccagggggccctggcaggaatggaaccgaaagagtttcaagctctacgccagcacgccaaggatgctggctgcacgctcgtcgagcatatcgaatccccctcaagcatttgggtgttcgccggtgcacctgacagatgtccacccacttgcctgtttgtgggaggaatggccgagcttggcgctttctttagtatactgcaggatatgaggaacaccatcatggcgtctaaaacagtcggcactgcagacgaaaagttgcggaagaaatccagcttctaccaatcgtacctccgacgcacccagtctatggggattcagctggatcagagaatcatagttatgtttatggtggcctggggaaaggaggctgtagacaatttccctttagtgcacgatatggacccaaaactgaggtccctctcacaaattcttatcgaccagaaggtcaacgaaatcagtaatcaggagcccatgaaactgtga

SEQ ID NO: 5872 - RNA, 1290 nt, synthetic construct
  misc_feature 1..1290: note = derived and/or modified CDS sequence (opt3) from SEOV(CixiRn21)__FJ803205.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggaaacccagtgaatcgggactatatccgtcagcgccagggcgccctggcagggatggaaccgaaagagtttcaagctctaagacagcactccaaggatgccggatgcacgctcgtcgagcatatcgaatcacccagcagtatttgggtgttcgctggcgcccctgacaggtgtccacccacttgcctgtttgtgggtgggatggatgagcttggagcattcttttctatactgcaggacatgcggaacaccatcatggcctccaaaacagtcggcactgctgatgaaaagttgcgaaagaaaagctcgttctaccaatcttacctccgcagaacccagtccatgggcattcagctggaccacaggatcatagttatgtttatggtggcgtgggggaaggaggcagtagataatttccacttaggagacgacatggatcctgaactgcggacactcgcccagattcttatcgaccaaaaagtgaaggagatctcaaaccaggagccaatgaaactgtga

SEQ ID NO: 5873 - RNA, 1290 nt, synthetic construct
  misc_feature 1..1290: note = derived and/or modified CDS sequence (opt3) from SEOV(CixiRn76)__FJ803206.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagttcccaaaacgcccagtctagcatgaaagcggaggaaataactccaggacgcttccgaacagcagtgtgcggcctctaccccgcccagattaaggctagaaatatggtctcccctgtgatgtcagtagttggctttttagccctggcaaaagattggaccagtaggatcgaggaatggcttggggctccatgtaagttcatggccgagagccccattgcgggatctttgtccggtaaccctgtgaatcgggactatatccgtcagggccaaggggccctggcaggaatggaaccaaaagagtttcaggctctacgccagcacgccaaggatgctggctgcacgctcgtcgagcatatcgaatcaccgagcagtatttgggtgttcgccggtgcaagagacaggtgtccccctacttgcctgtttgtcgggggaatggccgagcttggcgctttcttttctatactgcaagatatgcggaacaccatcatggcgtccaaaacagtgggcactgcagacgaaaagttgcgaaagaaaagctcgttctaccagtcttacctccgcagaacccagtccatggggattcagctggatcaaaggatcatagttatgtttatggtggcctggggaaaggaggctgtagacaatttccacttaggtgatgacatggacccagaactgcggtcactcgcccagattcttatcgatcagaaagtgaaggagatcagtaaccaggagcccatgaaactgtga

SEQ ID NO: 5874 - RNA, 1290 nt, synthetic construct
  misc_feature 1..1290: note = derived and/or modified CDS sequence (opt3) from SEOV(CUI)__GQ279395.1__N
  source 1..1290: mol_type = other RNA
atggccaccatggaggaactgcagagagagatcagcgctcacgaaggccaactcgtgattgcaaggcagaaggtcaaagacgccgagaagcagtacgaaaaagatcccgacgatcttaacaagcgggcgctgcatgaccgcgagtccgttgctgcctctatacagtcaaaaatcgatgagttgaagcgacaattagcagaccgtattgccgctgggaagaatatcggacaggatagagaccctacaggtgtggaaccaggcgatcacctgaaagagaggagtgcactaagctatgggaacactctcgaccttaattccctggatattgacgaaccgacgggacagaccgccgattggctgacaatcatagtatacttgacttctttcgtggtccccatcattctcaaggctctgtatatgctgaccacacggggccgccagacctcgaaagacaacaagggtatgagaatcaggtttaaagacgattcaagctacgaggacgtgaatgggattcggaagcctaagcatctctatgttagtatgccaaacgcccaatcctctatgaaagcggaggaaatcactcccggacgcttccgaacagcagtgtgcggcttataccctgcccagataaaggctagaaatatgctgagcccagtcatgtccgtggtaggctttcttgccttggcaaaagattggacctcaaggattgaggaatggctgggggctccctgtaagttcatggccgagagtcctatcgcgggaagcctatctggtaacccagttaatcgggactatattcgtcagcgccagggcgccctcgcagggatggaaccgaaagagtttcaagctctgagacagcactccaaggatgccggatgcacgcttgtggagcatatcgaatcacccagcagtatctgggtcttcgctggcgcccctgacaggtgtccacccacttgcctgtttgtgggtgggatggcagagttgggagccttcttttctattctccaggatatgcggaacaccataatggcttccaaaacagtgggcactgcggacaagaagctgcgcaaaaagagctcgttctaccaatcttacttacgaagaacccagtccatgggcatccagctggatcagaggattatcgtcatgtttatgttcgcatgggggaaagaagccgttgacaattttcacctcggagatgacatggaccctgagcttcggggtctggctcaaatattgattgatcagaaggtgaaagaaatctcaaaccaggagccaatgaagctatga

SEQ ID NO: 5875 - RNA, 1290 nt, synthetic construct
  misc_feature 1..1290: note = derived and/or modified CDS sequence (opt3) from SEOV(FeixianRn1)__GU592942.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattacgggtagcttgtctggaaacccagtgaatcgggactatatccgtcagcgccagggcgcgctggccgggatggaaccgaaagagtttcaagcactaagacagcacgctaaggatgccggatgcactctcgtcgagcatatcgaatccccctcaagcatttgggtgttcgctggcgcccctgacaggtgtccacctacctgcctgtttgtgggtgggatggcagagcttggagccttctttagtatactgcaggatatgcggaacacaatcatggcttctaaaactgtcggcaccgcggacgaaaagttgcgaaagaaatccagcttctaccaatcgtacctccgcagaacacagtctatgggcattcagctggatcagaggatcatagttatgtttatggtggcatgggggaaggaggccgtagacaatttccacttaggagatgacatggaccccgaactgcggtccctcgctcaaattcttatcgatcagaaagtgaaggagatctcaaaccaggagccaatgaaactgtga

SEQ ID NO: 5876 - RNA, 1290 nt, synthetic construct
  misc_feature 1..1290: note = derived and/or modified CDS sequence (opt3) from SEOV(GanyuRn66)__GU592932.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcacggccgagagtcctattgcgggtagcttgtctggaaacccagtgaatcgggactatatccgtcagcgccagggcgccctggcagggatggaaccgaaagagtttcaagctctaagacagcacgccaaggatgctggatgcactctcgtcgagcatatcgaatccccctcaagcatttgggtgttcgccggcgcacctgacaggtgtccacctacctgcctgtttgtgggtgggatggccgagcttggagctttctttagtatactgcaggatatgcggaacacaatcatggcgtctaaaactgtcggcaccgcagacgaaaagttgcgaaagaaatccagcttctaccaatcgtacctccgcagaacacagtctatgggcattcagctggatcagaggatcatagttatgtttatggtggcctgggggaaggaggctgtagacaatttccacttaggagatgacatggaccccgaactgcggtccctcgcccaaattcttatcgatcagaaagtgaaggagatctcaaaccaggagccaatgaaactgtga

SEQ ID NO: 5877 - RNA, 1290 nt, synthetic construct
  misc_feature 1..1290: note = derived and/or modified CDS sequence (opt3) from SEOV(Gongzhuling108)__KF745947.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagtccgcgcttcatgaccgggagtctgttgctgcctcaatccagagtaaaattgatgagctgaagcgccaattggcagaccgaatcgccgctgggaagaatattggacaggatcgtgaccctacaggtgtggaaccaggcgatcacttaaaagagagaagcgcactgtcctatgggaacactctagacctcaattctctggatatcgacgaaccgacgggacagaccgccgattggcttacaatactggtatacttgacttcgttcgtggtccccatcattctcaaggctctgtatatgctgaccacaaggggccggcagacctcaaaagacaacaagggtatgcgcatcagatttaaagacgatgggagctacgaggacgtgaatggaattaggaagcctaagcatctctatgttccaatgcccaacgcccaaagttccatgaaagcggaggaaatcactcctggccggttccgcacagcagtgtgcggcttatacccagcccagataaagccccgaaatatggtctctcctgtgatgagcgtagttgggtttctggctcttgccaaagattggacctccagaattgaggaatggttgggagcaccatgtaagttcatggctgagtcaccgatcgccggtagtctgagcggcaaccccgtgaatagggactatattcggcagcgtcagggggcgctagccggaatggaacctaaagagtttcaagcactccgccagcacgctaaggatgccggctgcacgctggtcgagcatatcgaatctccatcctcaatcagagtgttcgctggtgcccccgcaaggtgtcctccaacttgcctttttgtcgggggaatggccgagctgggcgctttctttagcattttgcaggacatgcggaacaccataatggcgagtaaaacagtgggcactgcagatgaaaagctccgaaagaaatcttccttctaccaaagctacctgcgcagatcgcagtctatggggatccagttagaccagaggattatcgttatgtttatggtggcctccggaaaggaggctgtagataatttccacctgggtgacgatatggaccccgaactccggtcacttgtgcaaatactgattgaccagaaagtcaaggagatcagtaaccaggagccgatgaaattgtga

SEQ ID NO: 5878 - RNA, 1290 nt, synthetic construct
  misc_feature 1..1290: note = derived and/or modified CDS sequence (opt3) from SEOV(Gongzhuling147)__KF745948.1__N
  source 1..1290: mol_type = other RNA
atggccaccatggaggaaatccagagagagattagcgctcacgaaggccaactggtgatagcaaggcagatcgtcaaggacgccgagaaacagtacgaaaaggatcccgcggacctcaacaaacgggcccttcatgatcgcgagtccgttgctgcatctattcagtcaaagatcgacgagctgaaacgacacttggccgatcgtattgctgcagggaagaatatcggacaagacagagatcctacaggtgtggaaccaggcgaccatttaaaggagaggagtgccctgagctatgggaacactctagatctcaattccctggacatagatgaaccgacgggacagaccgctgactggcttacaatcattgtatacctgacttctttcgtggtccccatcattttgaaagccctctatatcctgaccacatcgggccggcagacctcaaaggataacaaaggtatgcgcataagatttaaggacgacagcagttacgaggatgtgaatgggattaggatgcctaaacacctgtatgttccaatgcccaacgcgcagtcctctatgaaggcagaggacatcactcctggacggttccgcacagccgtgtgcggcctctacccagctcaaattaaggcccgaaatatggtcagccccttaatgtccgtggtaggctttctggcacttcctaaagattggacctcaagaatcgacgaatggttgggggctccatgtaagttcatggccgagagtccgatcgcgggaagcctgtctggtaaccccgttaatagggatcatattcggcagcgtcagggcgccctagcagggatggaccctaaagaatttcaggctgtgcgccaacacgccaaggatgctggatgcacgctcgtcgagcacatagaatccccatcaagcatctgggtgttcgccggcgcacccgacagatgtcctccaacttgcctgtttgtgggtgggatggccgagcttggagctttctttaccattctgcaggatatgaggaacacaatcatgcccagtaaaactgtcggcaccgcggacgagaagttgcggaaaaagtcttccttctatcagagctacctccgacgcacacaatcgatgggcatacagctggatcagagaattatcgttatctttatggtggcatgggccaaggaagctgtagacaatttccatttaggggacgatatggacccggagctgaggtctctcgcccagattcttatcgatcaaaaagtgaaggaaatttccaaccaggtccctatgaaactgtga

SEQ ID NO: 5879 - RNA, 1290 nt, synthetic construct
  misc_feature 1..1290: note = derived and/or modified CDS sequence (opt3) from SEOV(Gongzhuling415)__KF745949.1__N
  source 1..1290: mol_type = other RNA
atggccaccatggaggaaatccagagagagattagcgctcacgaaggccaactggtgatagcaaggcagatggtcaaggacgccgagaaacagtacgaaaaggatctcgcggaccttaacaaacgggctctgcatgatcgcgagtccgttgccgcatctatccagtcaaagattgacgagttgaaacgacaattagccgatcgtatcgctgcagggaagaatattgaacaggacagagatcccacaggagtggagcctggtgaccacctgaaggaaaggagtgccctaagctatggcaacactctcgatcttaattccctggacatcgatgagccaacggggcagaccgctgactggctgacaataatcgtatacttgacttctttcgtggtcccgattatcctcaaagccctgtatattctgaccacacggggacgccagacctcgaaggataacaaaggcatgactatcagatttaaggacgactcaagctacgaggatgtgaatggtataaggatgcccaaacatctctatgttcctatgccaaacgcgcaaagttccatgaaggcagaagacattacacccgggcggttccgcaccgccgtgtgcggattataccctgctcagatcaaggcccgaaatatggtctctccactgatgagcgtggtaggctttcttgcattgcccaaagattggacgtccagaattgacgagtggctgggcgctccttgtaagttcatggccgaatcaccaatcgcggggagtctaagcggaaacccggttaatagggatcacatccggcagcgtcagggtgccctcgcaggcatggaccccaaagagtttcaagctgtgcgccagcatgccaaggatgctgggtgcactctggtcgaacacattgagtctccttcctcaatatgggtgttcgccggagcaccagacagatgtcttcctacctgcctgtttgtgggcggtatggccgagttgggggctttctttacaatcctccaggatatgaggaacactattatggcgagcaaaaccgtcggaacagcagacgaaaagctgggcaaaaagagttctttctatcaatcctacttacggcgaacccagagcatgggcatccagctggatcagcgcataattgttatgtttatggtggcctgggctaaggaggccgtagacaatatccacctcggggacgatatggaccccgaacttagatcgctggcacaaatcttgattgatcagaaagtgaaggagatctctaaccaggtcccaatgaaactatga

SEQ ID NO: 5880 - RNA, 1290 nt, synthetic construct
  misc_feature 1..1290: note = derived and/or modified CDS sequence (opt3) from SEOV(Gongzhuling42)__KF745942.1__N
  source 1..1290: mol_type = other RNA
atggccaccatggaggaaatccagagagagattagcgctcacgaaggccaactggtgatagcaaggcagaaggtcaaagacgcccagaagcagtacgagaaagatcccgacgatctcaacaagcgggcgcttcatgaccgcgaatccgttgctgcctctatccaactgaaaattgatgagttgaagcgacagttagcagaccgtatcgccgctgggaagaatattggacaggatagagaccctacaggtgtggagccaggcgatcacctgaaagaaaggtcagcactaagttatgggaacactctcgacctgaatagccttgatatcgacgagccgacgggacagaccgccgattggctgacaataatcgtatacttgacttccttcgtggtccccattatcctcaaggctctgtatatgctgaccacacggggccgccaaacctctaaagacaacaagggtatgagaattaggtttaaagacgattcgtcatacgaagacgtgaaggggatccggaagcctaaacatctctatgttccaatgcccaatgcccagagcagtatgaaggcggaggagataactcctggacgctgccgaacagcagtgtgtggcttatacccagcccagattaaagctagaaacatggtctcccccgtgatgtctgccgtaggcatcctggcacttgctaaggattggaccagcaggattgaagagtggttggggacgccttgcaaattcatggccgaatccccaatcgcgggatcactgagtggtaatccggttaaccgggaccacatccgtcagcgccaaggcgccctagcagggatggagcccaaggaatttcagggactcagacagcatgctaaagatgccggctgtactctggtggagcacattgagagcccttcttccatatgggtcttcgctggtgccccagacaggtgtccccctacctgcctttttgtcgggggaatggcagaactgggcgccttctttgctatcttgcaagatatgcggaatacaattatggcgtcaaagactgtgggcaccgcagacgagaagctccgcaaaaagagcagtttctatcagtcttacctgcgaagaacacagtccatggggatccagttagatcaaaggataattgtgatgtttatggttgcctgggctaaagaagccgtggacaacttccacctgggagatgacatggacccagagctccggagccttgcacagatcctgatggatcagaaggtaaaagaaatctcgaatcaggagcccatgaagttgtga

SEQ ID NO: 5881 - RNA, 1290 nt, synthetic construct
  misc_feature 1..1290: note = derived and/or modified CDS sequence (opt3) from SEOV(Gongzhuling45)__KF745943.1__N
  source 1..1290: mol_type = other RNA
atggccaccatggaggaaatccagagagagattagcgctcacgaaggccaactggtgatagcaaggcagatggtcaaggacgccgagaaacagtacgaaaaggatcccgcggacctcaacaaacgggcccttcatgatcgcgagtccgttgctgcatctatccagtcaaagattgacgagctgaaacgacaattggccgatcgtatcgctgcagggaagaatattggacaggacagagatcctacaggtgtggaaccaggcgaccacttaaaggagaggagtgccctgagctatcggaacactctagatctcaattccctggacatcgatgaaccgacggggcagaccgctgactggcttacaataatcgtatacctgacttctttcgtggtccccattatcttgaaagccctctatattctgaccacacgcggaagacagacctcgaaggataacaaaggcatgaggatccggtttaaggacgactcaagctacgaggatgtgaatggtatacgcatgcctaaacatctgtatctcccaatgcccaacgcgcaaagttccatgaaggcagaggacattactcctgggcgattcagaacagccgtttgcggattatacccagctcagatcaaggccaggaatatggtgtctcccctgatgagcgtcgtgggctttcttgcattgcctaaagattggacctcccggattgacgaatggctgggcgctccatgtaagttcatggccgagtcaccgatcgcggggagtctaagcggaaaccccgtaaatcgtgatcacatccgccagagacagggtgccctcgcaggcatggaccctaaagaatttcaagctgttaggcagcatgccaaggatgctgggtgcacgctggtggagcacattgaatctccatcctcaatatgggtcttcgccggagcacccgaccggtgtcctccaacttgcctttttgtgggcggtatggccgagctgggggctttctttaccatcttgcaggatatgcgaaacacaattatggcgagcaaaactgtgggaaccgcagacgagaagctccgcaaaaagagttctttctatcaatcctacctgagaaggacacagagcatgggcatccagttagatcagcggataattgtcatgtttatggttgcctgggctaaggaagccgtggacaatttccacctgggcgacgatatggaccccgagctccgctcgcttgcacaaatcctgatcgatcataaagtaaaggaaatttctaaccaggtgccgatgaaattgtga

SEQ ID NO: 5882 - RNA, 1290 nt, synthetic construct
  misc_feature 1..1290: note = derived and/or modified CDS sequence (opt3) from SEOV(Gongzhuling58)__KF745944.1__N
  source 1..1290: mol_type = other RNA
atggccaccatggaggaaatccagagagagattagcgctcacgaaggccaactggtgatagcaaggcagatggtcaaggacgccgagaaacagtacgaaaaggatcccgcggacctcaacaaacgggcccttcatgatcgcgagtccgttgctgcatctatccagtcaaagattgacgagctgaaacgacaattggccgatcgtatcgctgcagggaagaatattggacaggacagagatcctacaggtgtggaaccaggcgaccacttaaaggagaggagtgccctgagctatgggaacactctagatctcaattccctggacatcgatgaaccgacgggacagaccgctgactggcttacaataatcgtatacctgacttctttcgtggtccccattatcttgaaagccctctatattctgaccacacggggccgccagacctcgaaggataacaaaggtatgagaatcaggtttaaggacgactcaagctacgaggatgtgaatgggatacggatgcctaaacatctgtatgttccaatgcccaacgcgcaaagttccatgaaggcagaggacattactcctggacgcttccgaacagccgtgtgcggcctctacccagctcagatcaaggccagaaatatggtctctcccttaatgagcgtggtaggctttctggcacttcctaaagattggacctccaggattgacgaatggttgggggctccatgtaagttcatggccgagtcaccgatcgcgggaagtctgagcggtaaccccgttaatcgggatcacatccgtcagcgccagggcgccctagcagggatggaccctaaagaatttcaagctgtgagacagcatgccaaggatgctggatgcacgctcgtcgagcacattgaatctccatcctcaatatgggtgttcgccggcgcacccgacaggtgtcctccaacttgcctgtttgtgggtgggatggccgagcttggagctttctttaccatcctgcaggatatgcggaacacaattatggcgagcaaaactgtcggcaccgcagacgagaagttgcgcaaaaagagttctttctatcaatcctacctccgaagaacacagagcatgggcatccagctggatcagaggataattgttatgtttatggtggcctgggctaaggaagccgtagacaatttccacttaggggacgatatggaccccgagctgcggtcgctcgcacaaatccttatcgatcagaaagtgaaggaaatttctaaccaggtcccgatgaaactgtga

SEQ ID NO: 5883 - RNA, 1290 nt, synthetic construct
  misc_feature 1..1290: note = derived and/or modified CDS sequence (opt3) from SEOV(Gongzhuling85)__KF745945.1__N
  source 1..1290: mol_type = other RNA
atggccaccatggaggaaatccagagagagattagcgctcacgaaggccaactggtgatagcaaggcagatggtcaaggacgccgagaaacagtacgaaaaggatcccgcggacctcatcaaacgggcccttcatgatcgcgagtccgttgctgcatctattcagtcaaagatcgacgagctgaaacgacaattggccgatcgtattgctgcagggaagaacatcggacaggacagagatcctacaggtttagaaccaggcgaccacctgaaggagaggagtgccctaagctatgggaatactctcgatctgaactcccttgacatagatgaaccgacgggacagaccgctgactggctgacagtgatcgtatacttgacttctttcgtggtccccattatcctcaaagccctgtatattctgaccacacggggccgccagacctcgaaggataataaaggtatgagaatcaggtttaaggacgtgtcaagctacgaggacgttaacgggatacggatgcctaaacatctctatgtgccaatgcccaatgcgcaaagttccatgaaggcagaggatattactcctggacgcttccgaacagccgtctgcggcttatacccagctcagatcaaggccagaaacatggtgtctcccctgatgagcgtagttggctttcttgcattgcctaaagactggacctccaggattgatgaatggctgggggctccatgtaagttcatggccgagtcaccgatcgcgggaagtctaagcggtaatcccgtgaaccgggaccacatccgtcagcgccagggcgccctcgcagggatggatcctaaagaatttcaagctgtcagacagcatgccaaggacgctggatgcacgctggtggagcacattgaatctccatcctcaatatgggtgttcgccggcgcacccgataggtgtcctccaacttgcctttttgtccggggtatggccgagctgggggctttctttaccatcttgcaggacatgcgaaatacaattatggcgagcaaaactgttggaaccgcagatgagaagctccgcaaaaagagttctttctatcaatcctacctgagaaggacacagagcatgggcatccagttagaccagcggataattgtgatgtttatggtagcctgggctaaggaagccgtggataacttccacctgggcgacgacatgcatcccgagctccgctcgcttgcacaaatcctgatcgatcagaaagtcaaggaaatttctaatcaggtgccgatgaaattgtga

SEQ ID NO: 5884 - RNA, 1290 nt, synthetic construct
  misc_feature 1..1290: note = derived and/or modified CDS sequence (opt3) from SEOV(Gongzhuling97)__KF745946.1__N
  source 1..1290: mol_type = other RNA
atggccaccatggaggaaatccagagagagattagcgctcacgaaggccaactggtgatagcaaggcagatggtcaaggacgccgagaaacagtacgaaaaggatcccgcggacctcaacaaacgggcccttcatgatcgcgagtccgttgctgcatctatccagtcaaagattgacgatctgaaacgacaattggccgaccgtatcgctgcagggaagaatattggacaggatagagaccctacaggtgtggagccaggcgatcacttaaaggaaaggagtgccctgagctatgggaacactctagacctcaattccctggatatcgacgagccgacgggacagaccgctgattggcttacaataatcgtatacctgacttctttcgtggtccccattatcttgaaagccctctatatgctgaccacacggggccgccagacctcgaaggacaacaaaggtatgagaattaggtttaaggacgattcaagctacgaagacgtgaatgggatccggatgcctaaacatctgtatgttcgcatgccaaacgcgcaaagttccatgaaggcagaggatataactcccggacgattcagaacagccgtgtgcggcctctaccctgctcagattaaggccaggaatatggtctctccattaatgagcgtggtaggctttctggcacttcccaaagactggacctcccggatcgatgagtggttgggggctccttgtaagttcatggccgaatcaccaattgcgggaagtctgagcggtaacccggttaatcgtgaccacatccgccagagacagggcgccctagcagggatggatcccaaagagtttcaagctgtgaggcagcatgccaaggacgctggatgcacgctcgtcgaacacatcgagtctccttcctcaatttgggtgttcgccggcgcaccagatcggtgtccccctacttgcctgtttgtgggtgggatggccgaacttggagctttctttaccatactgcaggacatgcgaatcacaattatggcgagcaaaactgtcggcaccgcagatgagaagttgcgcaaaaagagttctttctatcaatcctacctcagaaggacacagagcatgggcatccagctggaccagcggttaatagttatgtttatggtggcctgggctaaggaggccgtagacaacttccacctgggggatgacatggatccagaactccgctcgcttgcacaaattctgatcgaccagaaagtgaagcagatctctaatcaggtccccatgaaattgtga

SEQ ID NO: 5885 - RNA, 1290 nt, synthetic construct
  misc_feature 1..1290: note = derived and/or modified CDS sequence (opt3) from SEOV(Gou3)__AB027522.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggcagcttccgcacagcagtgtgcggactctaccctgccaccattaaggctcgaaatatggtctccccagtgatgtcagtagttggctttttagccctggcaaaagattggacgagtagaatcgaggactggcttggggctccctgtaagttcatggccgaaagccctattgcgggatctttgtccggtaacccagtgaatagggattatatccggcagcgtcagggcgccctggcagggatggagccgaaagaatttcaggctctacgccaacactcaaaggacgccggatgcactatggtcgagcagatcgagagccccagttctatttgggtgttcgctggcgcccctgatagatgtccacctacctgcctctttgtgggtgggatggcagaactgggagccttcttttccatacttcaggacatgaggaacacaatcatggctagcaaaactgtcggcaccgcggatgagaagctgcggaagaaatcgtctttctaccaatcctacttgcgacgcacacagtcaatgggcattcagctcgaccagagaatcatagttatgtttatggtggcatgggggaaggaagccgtagataatttccatctgggagacgacatggatcccgagttaaggagtctggctcaaattctcatcgaccagaaagtgaaggaaatcagcaaccaggagccaatgaaactttga

SEQ ID NO: 5886 - RNA, 1290 nt, synthetic construct
  misc_feature 1..1290: note = derived and/or modified CDS sequence (opt3) from SEOV(Hb8610)__AF288643.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagagtattggacaggatagagaccctacaggtgtggaaccaggcgatcacttaaaagagaggagcgcactgtcctatgggaatactctagacctcaactctctggatatcgacgaaccgacgggacagaccgccgattggcttacaataatcgtatacctgacttcgttcgtggtccccattatcttgaaggctctctatatgctgaccacacggggccgccagacctcaaaagacaataagggtatgagaattaggtttaaagacgatagcagttacgaggacgtgaacgggatccggaagcctaagcatctgtatgtttccatgccaaatgcccaatctagcatgaaagcggaggaaataactcccggacgcttccgaacagcagtgtgcggcctctaccctgcccagattaaggctagaaacatggtctccccagtgatgtcagtagttggctttttagccctggcaaaagattggaccagtaggatcgaggaatggcttggggctccctgtaagttcatggccgagagccctattgcgggatctttgtccggtaatccagtgaaccgggactatatccgtcagcgccagggcgccctggcagggatggaaccgaaagagtttcaagctctaagacagcacgccaaggatgctggatgcacgctcgtcgagcatatcgaatcacccagcagtatttgggtgttcgccggcgcacctgacaggtgtccacccacttgcctgtttgtgggtgggatggccgagcttggagctttcttttctatactgcaggatatgcggaataccatcatggcgtccaaaacagtcggcactgcagacgaaaagttgcgaaagaaaagctcgttctaccaatcttacctccgcagaacccagtccatgggcattcagctggatcagaggatcatagttatgtttatggtggcctgggggaagaaagctgtagacaacttccacttaggagatgacatggaccctgagctgcggtcactcgcccaaattcttatcgatcagaaggtgaaagaaatcagtaatcaggagccaatgaagctgtga

SEQ ID NO: 5887 - RNA, 1290 nt, synthetic construct
  misc_feature 1..1290: note = derived and/or modified CDS sequence (opt3) from SEOV(HuBJ16)__GQ279380.1__N
  source 1..1290: mol_type = other RNA
atggccaccatggaggaaatccagagagagattagcgctcacgaaggccaactggtgatagcaaggcagaaggtcaaaaacgccgagaagcagtacgaaaaagaccccgatgacctcaataagcgggcgcttcatgatcgcgagtccgttgctgcctctatccagtcaaaaattgacgagctgaagcgacaattggcagatcgtatcgccgctgggaagaacattggacaggacagagatcctacaggtgtggaaccaggcgaccacttaaaagagaggagtgcactgagctatgggaatactctagatctcaactccctggacatcgatgaaccgacgggacagaccgccgactggcttacaataatcgtatacctgacttctttcgtggtccccattatcttgaaggctctctatatgctgaccacacggggccgccagacctcgaaagataataagggtatgagaattaggtttaaagacgactcaagctacgaggatgtgaacgggatccggaagcctaagcatctgtatgttagtatgccaaatgcccaatcctctatgaaagcggaggaaataactcccggacgcttccgaacagcagtgtgcggcctctaccctgcccagattaaggctagaaacatggtcagcccagtgatgtccgtagttggctttttagccctggcaaaagactggacctcaaggatcgaggaatggcttggggctccctgtaagttcatggccgagagtcctattgcgggtagcttgtctggaacgccagtgaatcgggattatatccgtcagcgccagggcgccctggcagggatggaaccgaaagagtttcaagctctaagacagcacgccaaggacgctggatgcactctcgtcgagcatatcgaatccccctcaagcatttgggtgttcgccggcgcacctgataggtgtccacctacctgcctgtttgtgggtgggatggccgagcttggagctttctttagtatactgcaggacatgcggaacacaatcatggcgtctaaaactgtcggcaccgcagatgaaaagttgcgaaagaaatccagcttctaccaatcgtacctccgcagaacacagtctatgggcattcagctggaccagaggatcatagttatgtttatggtggcctgggggaaggaggctgtagataatttccacttaggagacgatatggaccccgaactgcggtccctcgcccaaattcttatcgaccagaaagtgaaggagatctcaaaccaggagccaatgaaactgtga

SEQ ID NO: 5888 - RNA, 1290 nt, synthetic construct
  misc_feature 1..1290: note = derived and/or modified CDS sequence (opt3) from SEOV(HuBJ22)__GQ279379.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggaacgccagtgaaccgggactatatccgtcagcgccagggcgccctggcagggatggaaccgaaagagtttcaagctctaagacagcacgccaaggatgctggatgcactctcgtcgagcatatcgaatccccctcaagcatttgggtgttcgccggcgcacctgacaggtgtccacctacctgcctgtttgtgggtgggatggccgagcttggagctttctttagtatactgcaggatatgcggaatacaatcatggcgtctaaaactgtcggcaccgcagacgaaaagttgcgaaagaaatccagcttctaccaatcgtacctccgcagaacacagtctatgggcattcagctggatcagaggatcatagttatgtttatggtggcctgggggaaggaggctgtagacaacttccacttaggagatgacatggaccccgaactgcggtccctcgcccaaattcttatcgatcagaaagtgaaggagatctcaaatcaggagccaatgaaactgtga

SEQ ID NO: 5889 - RNA, 1290 nt, synthetic construct
  misc_feature 1..1290: note = derived and/or modified CDS sequence (opt3) from SEOV(HuBJ3)__GQ279391.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagtgaacaagggtatgagaattaggtttaaagacgactcaagctacgaggatgttaatgggatccggaagcctaagcatctgtatgtgagtatgccaaacgcccaatcctctatgaaagcggaggaaataactcccggacgcttccgaacagcagtctgcggcctctaccctgcccagattaaggctagaaatatggtgagcccagtaatgtccgttgtgggctttttagccctggcaaaagactggacctcaaggatcgaggaatggcttggggctccctgtcggttcatggccgagagtcctattgcgggtagcttgtctggaaacccagtcaatcgtgattatatccgccagagacagggcgccctggcagggatggaaccgaaggagtttcaagctctaaggcagcacgccaaagacgctggatgcacgctcgtggagcatatcgaatccccctcaagcatttgggtgttcgccggcgcacctgagggttgtccacccacttgcctgtttgtcgggggaatggccgaacttggcgctttctttagtatactgcaggatatgcggaacaccatcatggcgtctaagacagttggcactgcagacgagaaattgcgaaagaagtccagcttctaccaatcgtacctccgcagaacccagtctatggggattcagctggatcagaggatcatagtgatgtttatggtagcctggggaaaagaagctgtggacaatttccacttaggtgatgacatggatcctgagctgcggtccctcgcccaaattcttatcgaccagaaggtcaaagagatctcaaaccaggaaccaatgaagctgtga

SEQ ID NO: 5890 - RNA, 1290 nt, synthetic construct
  misc_feature 1..1290: note = derived and/or modified CDS sequence (opt3) from SEOV(K24-e7)__AF288653.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatttcaacaagcgggcgctccatgaccgcgagtccgttgctgcctctatccagtcaaaaattgatgagcttaagcgacaactggcagaccgtatcgccgctgggaagaatattggacaggatagagaccctacaggtgtggaaccaggcgatcacttgaaagagaggagtgcattaagctatgggaacactctggacctaaattccctcgatatcgacgaaccgacgggacagaccgccgattggctgacaataatcgtataccttacttcttttgtggtccccattatcctgaaggctttgtatatgctcaccacacggggccgccagacctcgaaagacaacaagggtatgagaattaggttcaaagacgattcaagctacgaggacgtgaatgggatccggaagcctaagcatctgtatgttagtatgccaaacgcccaatcctctatgaaagcggaggaaataactcccggacgctttcgaacagcagtgtgcggcctgtaccctgcccagattaaggctagaaatatggtcagcccagtgatgtccgtagttggcttcctcgccttagcaaaagattggacctcaaggatcgaggaatggctgggggctccctgtaagtttatggccgagagtcctattgcgggaagcctttctggtaacccagtgaatcgggactatatccgtcagcgccagggcgccttggcagggatggaaccgaaagagttccaagctctgagacagcacgccaaggatgctggatgcacgctagtcgagcatatcgaatccccctcaagcatttgggtgtttgccggcgcacctgacaggtgtccacccacttgcctcttcgtgggtgggatggccgagctgggagcgtttttcagtatacttcaggatatgcggaacaccatcatggcttctaaaacagtcggcactgcagacgaaaagctgcgaaagaaatccagcttttaccaatcgtacttgcgcagaacccagtctatgggcattcagctcgatcagaggatcatagttatgttcatggtggcctgggggaaggaggctgtagacaattttcacctgggagatgacatggaccctgaattacggtccctggcccaaattctcatcgatcagaaagtgaaggagatctcaaaccaggagccaatgaaactttga

SEQ ID NO: 5891 - RNA, 1290 nt, synthetic construct
  misc_feature 1..1290: note = derived and/or modified CDS sequence (opt3) from SEOV(K24-v2)__AF288655.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatttcaacaagcgggcgctccatgaccgcgagtccgttgctgcctctatccagtcaaaaattgatgagcttaagcgacaactggcagaccgtatcgccgctgggaagaatattggacaggatagagaccctacaggtgtggaaccaggcgatcacttgaaagagaggagtgcattaagctatgggaacactctggacctaaattccctcgatatcgacgaaccgacgggacagaccgccgattggctgacaataatcgtataccttacttcttttgtggtccccattatcctgaaggctttgtatatgctcaccacacggggccgccagacctcgaaagacaacaagggtatgagaattaggttcaaagacgattcaagctacgaggacgtgaatgggatccggaagcctaagcatctgtatgttagtatgccaaacgcccaatcctctatgaaagcggaggaaataactcccggacgctttcgaacagcagtgtgcggcctgtaccctgcccagattaaggctagaaatatggtcagcccagtgatgtccgtagttggcttcctcgccttagcaaaagattggacctcaaggatcgaggaatggctgggggctccctgtaagtttatggccgagagtcctattgcgggaagcctttctggtaacccagtgaatcgggactatatccgtcagcgccagggcgccttggcagggatggaaccgaaagagttccaagctctgagacagcacgccaaggatgctggatgcacgctagtcgagcatatcgaatccccctcaagcatttgggtgtttgccggcgcacctgacaggtgtccacccacttgcctcttcgtgggtgggatggccgagctgggagcgtttttcagtatacttcaggatatgcggaacaccatcatggcttctaaaacagtcggcactgcagacgaaaagctgcgaaagaaatccagcttttaccaatcgtacttgcgccacacccagtctatgggcattcagctcgatcagagaatcatagttatgttcatggtggcctgggggaaggaggctgtagacaattttcacctgggagatgacatggaccctgaattaaggtccctggcccaaattctcatcgatcagaaagtgaaggagatctcaaaccaggagccaatgaaactttga

SEQ ID NO: 5892 - RNA, 1290 nt, synthetic construct
  misc_feature 1..1290: note = derived and/or modified CDS sequence (opt3) from SEOV(OuhaiRf35)__FJ803208.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggaaacccagtgaatcgggactatatccgtcagcgccagggcgccctggcagggatggaaccgaaagagtttcaagctctaagacagcacgccaaggatgctggatgcacgctcgtcgagcatatcgaatccccctcaagcatttgggtgttcgccggcgcaagggaccggtgtcctccaacttgcctgtttgtgggtgggatggccgagcttggagctttctttagtatactgcaggatatgcgaaacaccatcatggcgtctaaaacagtcggcactgcagacgaaaagttgcgcaagaaatccagcttctaccaatcgtacctcagaaggacccagtctatgggcattcagctggatcagcggatcatagttatgtttatggtggcctgggggaaggaggctgtagacaatttccacttaggagatgacatggaccccgaactgcgctccctcgcccaaattcttatcgatcagaaagtgaaggagatctcaaaccaggagcctatgaaactgtga

SEQ ID NO: 5893 - RNA, 1290 nt, synthetic construct
  misc_feature 1..1290: note = derived and/or modified CDS sequence (opt3) from SEOV(OuhaiRn146)__FJ803210.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcggggagcttgtctggtaacccagtgaatcgggactatatccgtcagggccagggggccctggcaggaatggaaccgaaagagtttcaagctctacgccagcacgccaaggatgctggctgcacgctcgtcgagcatatcgaatccccctcaagcatttgggtgttcgccggtgcaagagacaggtgtcctccaacttgcctgtttgtgggaggaatggccgagcttggcgctttctttagtatactgcaggatatgcggaacaccatcatggcgtctaaaacagtcggcactgcagacgaaaagttgcgaaagaaatccagcttctaccaatcgtacctccgcagaacccagtctatggggattcagctggatcagaggatcatagttatgtttatggtggcctggggaaaggaggctgtagacaatttccacttaggtgatgacatggaccccgaactgcggtccctcgcccaaattcttatcgatcagaaagtgaaggagatctcaaaccaggagcctatgaaactgtga

SEQ ID NO: 5894 - RNA, 1290 nt, synthetic construct
  misc_feature 1..1290: note = derived and/or modified CDS sequence (opt3) from SEOV(Pf26)__AY006465.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctgtgcagtcaaaaatcgatgagctgaagcgacaattggcagaccgtattgccgctgggaagaatatcggacaggatagagaccctacaggtgtagaaccaggcgatcacttaaaagagaggagtgcactgagctatgggaacactctagacctcaattccctggatattgacgaaccgacgggacagaccgccgattggcttacaatcatagtgtacctgacttctttcgtcgtgcccatcattttgaaggctctctatatgctgaccacacggggccgccagacctcgaaagacaacaagggtatgagaatcaggtttaaagacgattcaagctacgaggacgttaatgggattcggaagcctaagcatctgtatgtgagtatgccaaacgcccaatcctctatgaaagcggaggaaatcactcccggacgcttccgaacagcagtctgcggcctctaccctgcccagataaagccaagaaatatggtgagccccgtaatttccgttgtgggctttttagctctggccaaagattggacctcaaggatcgaggaatggcttggggcaccttgtaagttcatggctgagagtccaattgccggtagcttgtctggaaacccggtcaatcgggactatatccgtcagcgccagggcgcgctggccgggatggaacccaaagagtttcaagcactaagacagcacgctaaggatgccggatgcacgctcgtggagcatatcgaatccccttcaagcatttgggtgttcgctggcgccccagacaggtgtccccctacttgcctgtttgtcggtgggatggcagagcttggagccttctttagtatactgcaggatatgcggaacaccatcatggcttctaaaacagttggcactgcggacgaaaagttgcgaaagaaatccagcttctaccaatcgtacctccgcagaacccagtctatgggcattcagctggatcagaggatcatagtgatgtttatggtagcatgggggaaggaggccgtggacaatttccacttaggagatgacatggacccagaactgcggtccctcgctcaaattcttatcgatcagaaagtcaaggagatctcaaaccaggagcccatgaaactgtga

SEQ ID NO: 5895 - RNA, 1290 nt, synthetic construct
  misc_feature 1..1290: note = derived and/or modified CDS sequence (opt3) from SEOV(Rn-CP7)__GQ279382.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaagcatggtctccccagtgatgtcagtagttggctttttagccctggcaaaagattggaccagtaggatcgaggaatggcttggggctccctgtaagttcatggccgagagccctattgcgggatctttgtccggtaatccagtgaaccgggactatatccgtcagcgccagggcgccctggcagggatggaaccgaaagagtttcaagctctaagacagcacgccaaggatgctggatgcacgctcgtcgagcatatcgaatcacccagcagtatttgggtgttcgccggcgcacctgacaggtgtccacccacttgcctgtttgtgggtgggatggccgagcttggagctttcttttctatactgcaggatatgcggaataccatcatggcgtccaaaacagtcggcactgcagacgaaaagttgcgaaagaaaagctcgttctaccaatcttacctccgcagaacccagtccatgggcattcagctggatcagaggatcatagttatgtttatggtggcctgggggaaggaggctgtagacaacttccacttaggagatgacatggaccctgaactgcggtcactcgcccaaattcttatcgatcagaaagtgaaggagatcagtaatcaggagccaatgaaactgtga

SEQ ID NO: 5896 - RNA, 1290 nt, synthetic construct
  misc_feature 1..1290: note = derived and/or modified CDS sequence (opt3) from SEOV(Rn-DC8)__GQ279386.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccgcccggggccgccagacatcgaaagacaacaagggtatgagaattaggtttaaagacgattcaagctacgaggacgtgaatgggatccggaagcctaagcatctgtatgttagtatgccaaacgcgcaatcctctatgaaagcagaggaaataacccccggacgcttccgaactgccgtgtgcggcctctaccctgctcagattaaggccagaagcatggtctccccagtgatgtcagtagttggctttttagcactggctaaagattggacaagtaggatcgaggaatggcttggggccccctgtaagttcatggcggagagccctattgccggatctttgtccggtaatccagtgaaccgggactatatccgtcagcgccagggcgcactggctgggatggaaccgaaagagtttcaagccctaagacagcacgctaaggatgccggatgcaccctcgtcgagcatatcgaatcacccagcagtatttgggtgttcgcaggcgcccctgacaggtgtccacccacgtgcctgtttgtgggtgggatggctgagcttggagcgttcttttctatactgcaggatatgcggaatactatcatggcatccaaaaccgtcggcacagccgacgaaaagttgcgaaagaaaagctcgttctaccaatcttacctccgcagaactcagtccatgggcattcagctggatcagaggatcatagttatgtttatggtggcttgggggaaggaggccgtagacaacttccacttaggagatgacatggaccctgaactgcggtcactcgcacaaattcttatcgatcagaaagtgaaggagatcagtaatcaggagccaatgaaactgtga

SEQ ID NO: 5897 - RNA, 1290 nt, synthetic construct
  misc_feature 1..1290: note = derived and/or modified CDS sequence (opt3) from SEOV(Rn-M11)__GQ279383.1__N
  source 1..1290: mol_type = other RNA
atggccaccatggaggaaatccagagagagattagcgctcacgaaggccaactggtgatagcaaggcagaaggtcaaaaacgccgagaagcagtacgaaaaagaccccgatgacctcaataagcgggcgcttcatgatcgcgagtccgttgctgcctctatccagtcaaaaattgacgagctgaagcgacaattggcagatcgtatcgccgctgggaagaacattggacaggacagagatcctacaggtgtggaaccaggcgaccacttaaaagagaggagtgcactgagctatgggaatactctagatctcaactccctggacatcgatgaaccgacgggacagaccgccgactggcttacaataatcgtatacctgacttctttcgtggtccccattatcttgaaggctctctatatgctgaccacacggggccgccagacctcgaaagataataagggtatgagaattaggtttaaagacgactcaagctacgaggatgtgaacgggatccggaagcctaagcatctgtatgttagtatgccaaatgcccaatcctctatgaaagcggaggaaataactcccggacgcttccgaacagcagtgtgcggcctctaccctgcccagattaaggctagaagcatggtctccccagtgatgtcagtagttggctttttagccctggcaaaagactggaccagtaggatcgaggaatggcttggggctccctgtaagttcatggccgagagccctattgcgggatctttgtccggtaacccagtgaatcgggattatatccgtcagcgcagaggcgccctggcagggatggaaccgaaagagtttcaggctctaaggcaacacgccaaggacgctggatgcacgctcgtcgagcatatcgaatcacccagcagtatttgggtgttcgccggcgcacctgatcggtgtccacccacttgcctgtttgtgggtgggatggccgagcttggagctttcttttctatactgcaggacatgcgaaacaccatcatggcgtccaaaacagtcggcactgcagatgaaaagttgcgcaagaaaagctcgttctaccagtcttacctcagaaggacccaatccatgggcattcagctggaccagcggatcatagttatgtttatggtggcctgggggaaggaggctgtagataatttccacttaggagacgatatggaccctgaactgcgctcactcgcccagattcttatcgaccaaaaagtgaaggagatcagtaaccaggagccaatgaaactgtga

SEQ ID NO: 5898 - RNA, 1290 nt, synthetic construct
  misc_feature 1..1290: note = derived and/or modified CDS sequence (opt3) from SEOV(RuianRf74)__FJ803213.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaatggcagtgtgcggcctctaccctgcccagattaaggctagaaatatggtcagcccagtgatgtccgtagttggctttttagccctggcaaaagattggacatcaaggatcgaggaatggcttggggctccctgtaagttcatggccgagagtcctattgcgggtagcttgtctggaaacccagtgaatcgggactatatccgtcagcgccagggcgccctggcagggatggaaccgaaagagtttcaagctctaagacagcacgccaaggatgctggatgcaccctcgtcgagcatatcgaatccccctcaagcatttgggtgttcgccggcgcacctgacaggtgtccacccacgtgcctgtttgtgggtgggatggccgagcttggagctttctttagtatactgcaggatatgcggaacactatcatggcgtctaaaaccgtcggcacagcagacgaaaagttgcgaaagaaatccagcttctaccaatcgtacctccgcagaactcagtctatgggcattcagctggatcagaggatcatagttatgtttatggtggcctgggggaaggaggctgtagacaatttccacttaggagatgacattgaccctgaactgcggtccctcgcccaaatccttatcgatcagaaagtgaaggagatttcaaaccaggagccaatgaaactgtga

SEQ ID NO: 5899 - RNA, 1290 nt, synthetic construct
  misc_feature 1..1290: note = derived and/or modified CDS sequence (opt3) from SEOV(RuianRn23)__FJ803214.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggaaacccagtgaatcgggactatatccgtcagcgccagggcgccctggcagggatggaaccgaaagagtttcaagctctaagacagcacgccaaggatgctggatgcacgctcgtcgagcatatcgaatccccctcaagcatttgggtgttcgccggcgcacctgacaggtgtccacccacttgcctgtttgtgggtgggatggccgagcttggagctttctttagtatactgcaggatatgcggaacaccatcaaagcgtctaagacagtcggcactgcagacgaaaagttgcgcaaaaagtccagcttctaccaatcgtacctccgaagaacccagtctatgggcattcagctggatcagaggatcatagttatgtttatggtggcctgggggaaagaggctgtagacaatttccacttaggagatgacatggaccctgaactgcggtccctcgcccaaattcttatcgatcagaaggtgaaagagatctcaaaccaggagccaatgaagctgtga

SEQ ID NO: 5900 - RNA, 1290 nt, synthetic construct
  misc_feature 1..1290: note = derived and/or modified CDS sequence (opt3) from SEOV(RuianRn33)__FJ803215.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggaagcctgtctggtaacccagtgaatcgggactatatccgtcagcgccagggcgccctggcagggatggaaccgaaagagtttcaagctctaagacagcacgccaaggatgctggatgcacgctcgtcgagcatatcgaatccccctcaagcatttgggtgttcgccggcgcacctgacaggtgtccacccacttgcctgtttgtgggtgggatggccgagcttggagctttctttagtatactgcaggatatgcggaacaccatcatggcgtctaaaacagtcggcactgcagacgaaaagttgcgaaagaaatccagcttctaccaatcgtacctccgcagaacccagtctatgggcattcagctggatcagaggatcatagttatgtttatggtggcccgggggaaggaggctatgtataatttacacttgcgcgacgatatgacacctcaactccttctgttggtacagattctactggaccaccaggtgaaagaaatctccaaccaggagctcatgaagctgtga

SEQ ID NO: 5901 - RNA, 1290 nt, synthetic construct
  misc_feature 1..1290: note = derived and/or modified CDS sequence (opt3) from SEOV(SC106)__GU361893.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttccaatgcccaacgcccaaagttccatgaaagcggaggaaataactcctggacgcttccgaacagcagtgtgcggcctctacccagcccagattaaggctagaaatatggtctctcccgtgatgagcgtagttggctttttagccctggcaaaagattggacctccaggatcgaggaatggcttggggctccttgtaagttcatggccgagtcaccaattgcgggaagtttgagcggtaacccggtgaatcgggactatatccgtcagcgccagggcgccctggcagggatggaacccaaagagtttcaagctctaagacagcacgccaaggatgctggatgcacgctcgtcgagcatatcgaatctccttcctcaatttgggtgttcgccggcgcaccagacaggtgtccccctacttgcctgtttgtgggtgggatggccgagcttggagctttctttagcatactgcaggatatgcggaacaccatcatggcgagtaaaacagtcggcactgcagacgaaaagttgcgaaagaaatcttccttctaccaaagctacctccgcagaacccagtcgatgggcattcagctggatcagaggatcatagttatgtttatggtggcctgggggaaggaggctgtagacaatttccacttaggagatgacatggacccagaactgcggtctctcgcccaaattcttatcgatcagaaagtgaaggagatctccaaccaggagcccatgaaactgtga

SEQ ID NO: 5902 - RNA, 1290 nt, synthetic construct
  misc_feature 1..1290: note = derived and/or modified CDS sequence (opt3) from SEOV(SEO/Belgium/Rn895/2005)__JQ898106.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgacagtcctattgcgggtagcttgtctggaaacccagtgaatcgggattatatccgtcagcgccagggcgccctggcagggatggagccgaaagaatttcaagctctaagacagcactccaaggacgccggatgcacgctcgtcgagcatatcgagtcacccagcagtatttgggtgttcgctggcgcccctgataggtgtccacccacttgcctgtttgtgggtgggatggcagaacttggagccttcttttctatactgcaggacatgcggaacaccatcatggcttccaaaacagtcggcactgcggatgagaagttgcgaaagaaaagctcgttctaccaatcttacctccgcagaacccagtccatgggcattcagctggaccagaggatcatagttatgtttatggtggcatgggggaaggaagccgtagataatttccacttaggagacgacatggatcctgagctgcggtcactcgctcaaattcttatcgaccagaaagtgaaggaaatcagtaaccaggagccaatgaaactgtga

SEQ ID NO: 5903 - RNA, 1290 nt, synthetic construct
  misc_feature 1..1290: note = derived and/or modified CDS sequence (opt3) from SEOV(Taonan420)__KF745951.1__N
  source 1..1290: mol_type = other RNA
atggccaccatggaggaaatccagagagagattagcgctcacgaaggccaactggtgatagcaaggcagaacgtcaaggacgccgagaaacagtacgaaaaggatcccgacgatctcaataaacgggcgcttcatgaccgcgagtccgttgctgcctctatccagtcaaagattgatgagctgaaacgacaacctgcagaccgtatcgccgctgggaagaacattggacaggatagagacccaacaggtgtggaaccgggcgatcacttgaaggagaggagtgcattaagctatgggaatactctggacctaaaccggctcgatatcgacgaacccacgggacagcgcgccgattggctgaccataatcgtataccttacatccttcgtggtcagaattatcctgaaggctttgtatatgttttctactaggggccggcagacctcgaaggacaataaaggtctccgcattcgattcaaggacgattcaagctacgaggactttaacgggatcagaaaacctaagcatctgtatgtgccaatgcccaatgcccaaagttccatgaaggcggaggaaataacacctggaaggttccggaccgcagtttgcggcctgtacccagcccagattaaagctcgtaacatggtgtctcccgtcatgagcgtggtaggctttctcgccttagcaaaggattggacttcccgcatcgaggaatggctgggggctccttgtaaattcatggccgagtcaccaattgcgggaagtcttagcggtaatccggttaacagagactatatcaggcagcggcagggcgccttggcagctatggaacccaaggagtttcaagccctgcgacagcacgctaaagatcctgggtgcacactggtggagcatatcgaatctccatcctcaatttgggtcagcgccggagcacccgaccgctgtcctccaacctgcctcttcgtgggcggtatggccgagctgggggcgtttttcagtatatttcaggatatgagaaatacgatcatgccctctaagactgtgggaaccgctgacgaaaaacttaggaagaagtccctgttctaccaaagctacttgcggcgcacacagtcgatgggcattcagctcgatcagagaatcatagtcatgtttatggttgcatggggcaaagaggccgtggacaacttccacctaccggatgacatggaccctgaattaaggtctctggctcaaattctcatcgtacagaaggtgaaagagatctccaatcaggagcccatgaaactttga

SEQ ID NO: 5904 - RNA, 1290 nt, synthetic construct
  misc_feature 1..1290: note = derived and/or modified CDS sequence (opt3) from SEOV(Taonan52)__KF745950.1__N
  source 1..1290: mol_type = other RNA
atggccaccatggaggaaatccagagagagattagcgctcacgaaggccaactggtgacagcaaggcagaaggtcaaagacgccgagaagcagtacgaaaaagatcccgacgatctcaacaagcgggcgcttcatgaccgcgagtccgttgctgcctctatacagtcaaaaatcgatgaggtgaagcgacaactggcagaccgtattgccgctgggaagaatatcggacaggatagagaccctactggtgtagaaccaggcgatcacccgaaagagaggagtgcattgagctatgggaacacgttagacctaaattccctggatattgacgaacccaccggacagacagccgattggctcactatcatagtgtacctgacctctttcgtcgtgcctatcattcttaaggctctgtatatgtcgacaacccggggccgccagacttcaaaagacaacagaggtatgaggatccggtttcaagacgatagcagttacgaggacgttaatgggattcgcaagccaaaacatttgtatgtgcccatgcctaacgcccagtcctctatgaaggcggaggaagtcacaccaggacgattcagaaccgcagtgtgcggcctctaccccgcccagatcaaggctaggaatatggtacggcctgttatgagcgtggtcggctttctggccctggcaaaggcttggacgtcccgtatagaggaatggctcggggccccatgtaagttcatggcggagtcaccgattgccggaagtttaagcggtaaccccgtgtatcgcgattacatcagacagaggcaaggcgcactggctgggatggaacctaaagagtttcaggcccttcggcagcacgctaaggacgccggatgcactttggtggagctgattgaatctccatcctcaatcagcgtcttcgcaggcgcccccgatcgatgtcctagaacctgcctatttgttggtgggatggctgagctcggagcgaatttcagtatgctgcaagacatgtctaacacaatcatggcatccaaaactgtgggcaccgccgatgaaaaacttcgcaaaaagagctcgttttaccagtcttatctgaggcggacacagtccatgggcattcagttggaccaacgcataatcgtaatgttcatggtggcttcagggaaggaggccgtcgattactttcatctcggagacgatatggacccagaactgagaagtttagcacccattctgatcgaccagaaagtgaaggagataagcaatcaggagccgatgaaactctga

SEQ ID NO: 5905 - RNA, 1290 nt, synthetic construct
  misc_feature 1..1290: note = derived and/or modified CDS sequence (opt3) from SEOV(WuhanMm24)__JQ665911.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgctgccgcatctatccagtcaaaaattgatgagctgaagcgacaattggccgaccgtatcgctgcagggaagaatattggacaggatagagaccctacaggtgttgaaccaggcgatcacttaaaagagaggagtgccctgagctatgggaacactctagacctcaattccctggatatcgacgaaccgacgggacagaccgctgattggcttacaataatcgtgtacctgacttctttcgtagtgcccattatcttgaaggccctctatatgctgaccacacggggccgccagacctcgaaagacaacaagggtatgagaattaggtttaaagacgattcaagctacgaggacgtcaatgggatccggaagcctaagcatctgtatgtgagtatgccaaacgcgcaatcctctatgaaagcagaggaaataactcccggacgcttccgaacagccgtttgcggcctctaccctgctcagattaaggccagaaatatggtgagcccagtcatgtccgtggtaggctttttagcactggctaaagattggacctcaaggatcgaggaatggcttggggccccctgtaagttcatggcggagagtcctattgccggtagcttgtctggaaacccagttaatcgggactatatccgtcagcgccagggcgcactggctgggatggaaccgaaagagtttcaagccctaagacagcactccaaggatgctggatgcacgctcgtggagcatatcgaatcacccagcagtatttgggtcttcgccggcgcacctgacaggtgtccacccacttgcctgtttgtgggtgggatggccggacttggcgctttcttttctatactgcaggatatgcggaacaccatcatggcgtccaaaacagtgggcactgcagacgagaagttgcgaaagaaaagctcgttctaccaatcttacctccgcagaacccagtccatggggattcagctggatcagaggatcatagtcatgtttatggttgcctggggaaaggaagctgtggacaatttccacttaggtgatgacatggaccctgagctgcggtcactcgcccaaattcttatcgatcagaaagtaaaggaaatcagtaaccaggagccaatgaaactgtga

SEQ ID NO: 5906 - RNA, 1290 nt, synthetic construct
  misc_feature 1..1290: note = derived and/or modified CDS sequence (opt3) from SEOV(WuhanRf02)__JQ665912.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttagaggaaaggagtgcactgagctatgggaacactctagacctcaattccctggatatcgacgagccgacgggacagaccgccgattggcttacaataatcgtatacctgacttctttcgtggtccccattatcttgaaagctctctatatgctgaccacacggggccgccagacctcgaaggacaacaaaggtatgagaattaggtttaaggacgattcaagctacgaggacgtgaatgggatccggaaacctaagcatctgtatgttagtatgccaaacgcccaatcctctatgaaggcggaagagataactcccggacgcttccgaacagcagtgtgcggcctctaccctgcccagattaaagctagagatatggtcagcccagtgatgtccgtagttggctttttagccctggcaaaggactggacctcaaggatcgaagagtggcttggggctccctgtaaattcatggccgaaagtcctattgcgggtagcttgtctggaaatccagtgaaccgggattatatccgtcagcgccagggcgccctggcagggatggagccgaaggagtttcaagctctaagacagcactccaaagacgccggatgcacgctcgtcgaacatatcgagtcacccagcagtatttgggtgttcgctggcgccagggatcggtgtcctccaacttgcctgtttgtgggtgggatggcagaacttggagccttcttttctatactgcaggacatgcgaaataccatcatggcttccaagacagtcggcactgcggatgagaaattgcgcaaaaagagctcgttctaccaatcttacctcagaaggacccagtccatgggcattcagctggaccagcggatcatagttatgtttatggtggcatgggggaaggaagccgtagataacttccacttaggagacgacatggatcccgagctgcgctcactcgctcaaattcttatcgaccagaaggtgaaagagatcagtaatcaggaacctatgaagctgtga

SEQ ID NO: 5907 - RNA, 1290 nt, synthetic construct
  misc_feature 1..1290: note = derived and/or modified CDS sequence (opt3) from SEOV(WuhanRf07)__JQ665913.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggaaacccagtgaatcgggactatatccgtcagcgccagggcgccctggcagggatggaaccgaaagagtttcaagctctaagacagcactccaaggatgccggatgcacgctcgtcgagcatatcgaatcacccagcagtatttgggtgttcgctggcgccagggaccggtgtcctccaacttgcctgtttgtgggtgggatggcagagcttggagccttcttttctatactgcaggatatgcgaaacaccatcatggcttccaaaacagtcggcactgcggacgaaaagttgcgcaagaaaagctcgttctaccaatcttacctcagaaggacccagtccatgggcattcagctggatcagcggatcatagttatgtttatggtggcatgggggaaggaggccgtagacaatttccacttaggagatgacatggaccccgaactgcgctcactcgctcaaattcttatcgatcagaaagtgaaggagatcagtaaccaggagcctatgaaactgtga

SEQ ID NO: 5908 - RNA, 1290 nt, synthetic construct
  misc_feature 1..1290: note = derived and/or modified CDS sequence (opt3) from SEOV(ZJ5)__FJ753400.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggaaacctggtgaatcgggactatatccgtcagcgccagggcgccctagcagggatggaaccaaaagagtttcaagctctcagacagcactccaaggatgccggatgcacgctggtcgagcatatcgaatcaccgagcagtatttgggtgttcgctggcgcccccgacaggtgtcctccaacttgcctttttgtgggtgggatggcagagctgggagccttcttttctatattgcaggatatgcggaacaccatcatggcttccaaaacagtcggcactgcggacgaaaagctccgaaagaaaagctcgttctaccaatcttacctgcgcagaacccagtccatgggcattcagttagatcagaggatcatagttatgtttattgtggcatgggggaaggaggccgtagacaatttccacctgggagatgacctcgaccccgaacttcggtcactggctcaaatcttgatcgatcagaaagtgaaggagattagtaaccaggagcctatgaaactatga

SEQ ID NO: 5909 - RNA, 1290 nt, synthetic construct
  misc_feature 1..1290: note = derived and/or modified CDS sequence (opt3) from SEOV(ZT10)__AY766368.1__N
  source 1..1290: mol_type = other RNA
atggccctgtgcgaggaaatccagagagagattagcgctcacgaaggccaactcgtgatagcaaggcagaaggtcaaagacgccgagaagcagtacgaaaaagatcccgacgatttcaacaagcgggcgcttcatgaccgcgagtccgttgctgcctctatccagtcaaaaattgatgagctgaagcgacaattggcagaccgtatcgccgctgggaagaatattggacaggatagagaccctaccggtgtggaaccaggcgatcacttaaaagagaggagtgcactgagctatgggaacacactagacctcaattccctggatatcgacgaaccgactggacagacggccgattggcttaccataatcgtatacctgacatcttttgtggtccccattatcttgaaggctctctatatgctgactacccggggccgccagacatcgaaagacaacaagggtatgagaattaggttcaaagacgattcaagctacgaggacgtgaatgggatccggaagcctaagcatctgtatgttagtatgccaaacgcccaatcctctatgaaagcggaggaaataacccccggacgctttcgaactgcagtgtgtggcctctaccctgcccagattaaggctagaaatatggtcagcccagtgatgtccgtagttggcttcttagccctggcaaaagattggacatcaaggatcgaggaatggcttggggctccctgcaagtttatggccgagagtcctattgcgggtagcttgtctggaaacccagtgaatcgggactatatccgtcagcgccagggcgccctggcagggatggaaccgaaagagttccaagctctaagacagcacgccaaggatgctggatgtaccctcgtcgagcatatcgaatccccctcaagcatttgggtgtttgccggcgcacctgacaggtgcccacccacgtgtctgttcgtgggtgggatggccgagcttggagcgtttttcagtggcctggctgatatgcggaacactataatggcatctaaaaccgaaggcacagccgacgagaagttgcgaaagaaatccagcttttaccagtcgtacctccgcagacaacagtctatggggatccagctggatcagaggattatcgtcatgttcatggttgcttggggaaaggaagccgtggacaattttcacttaggtgatgacatggaccctgagctgcggtccctcgcacaaatacttattgatcagaaagtaaaggagatctcaaaccaggaaccaatgaaactgtga

SEQ ID NO: 5910 - RNA, 1290 nt, synthetic construct
  misc_feature 1..1290: note = derived and/or modified CDS sequence (opt3) from SEOV(ZT71)__AY750171.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatttcaacaagcgggcgctccatgaccgcgagtccgttgctgcctctatccagtcaaaaattgatgagcttaagcgacaactggcagaccgtatcgccgctgggaagaatattggacaggatagagaccctacaggtgtggaaccaggcgatcacttgaaagagaggagtgcattaagctatgggaacactctggacctaaattccctcgatatcgacgaaccgacgggacagaccgccgattggctgacaataatcgtataccttacttcttttgtggtccccattatcctgaaggctttgtatatgctcaccacacggggccgccagacctcgaaagacaacaagggtatgagaattaggttcaaagacgattcaagctacgaggacgtgaatgggatccggaagcctaagcatctgtatgttagtatgccaaacgcccaatcctctatgaaagcggaggaaataactcccggacgctttcgaacagcagtgtgcggcctgtaccctgcccagattaaggctagaaatatggtcagcccagtgatgtccgtagttggcttcctcgccttagcaaaagattggacctcaaggatcgaggaatggctgggggctccctgtaagtttatggccgagagtcctattgcgggaagcctttctggtaacccagtgaatcgggactatatccgtcagcgccagggcgccttggcagggatggaaccgaaagagttccaagctctgagacagcacgccaaggatgctggatgcacgctagtcgagcatatcgaatccccctcaagcatttgggtgtttgccggcgcacctgacaggtgtccacccacttgcctcttcgtgggtgggatggccgagctgggagcgtttttcagtatacttcaggatatgcggaacaccatcatggcttctaaaacagaaggcactgcagacgagaagctgcgaaagaaatccagcttttaccaatcgtacttgcgcagacagcagtctatgggcattcagctcgatcaaaggatcatagtcatgttcatggttgcctgggggaaggaagctgtggacaattttcacctgggagatgacatggaccctgagttacggtccctggcccagattctcatcgatcagaaagtaaaggagatctcaaaccaggaaccaatgaaactttga

SEQ ID NO: 5911 - RNA, 1290 nt, synthetic construct
  misc_feature 1..1290: note = derived and/or modified CDS sequence (opt3) from SEOV(zy27)__AF406965.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgattccaacaagcgggcgctccatgaccgcgagtctgttgctgcctcaatccagagtaaaattgatgagcttaagcgacaactggcagaccgtatcgccgctgggaagaatattggacaggatagagaccctacaggtgtggaaccaggcgatcacttgaaagagaggagcgcaccgtcctatgggaacactttagaccttaattctctagatatcgacgaacccacgggacagaccgccgattggctcacaataatcgtatacctgacttcgttcgtggtccctattatccttaaggctctgtatatgttgaccacacggggccgccagacctcaaaagacaacaagggtatgagaattaggtttaaagacgatagcagttacgaggacgtgaatgggatccggaagccaaagcatctctatgtttccatgcccaacgcccaatctagcatgaaagcggaggaaataactcctgagcgcttccgaacagcagtgtgcggactgtacccagcccagattaaggctagaaatatggtctcccccgtgatgtcagtagttggctttctggccctcgcaaaagattggaccagtaggatcgaagagtggttaggcgctccttgtaagttcatggccgaaagcccaattgcggggtctctgtccggaaacccggtgaatcgggaccacatccgtcagcgccagggtgcccttgcaggcatggagcccaaagagtttcaggctttgagacaacatgccaaggatgctgggtgcacgctggtcgaacacatcgagtcacctagcagtatttgggtgttcgccggagcaccagacaggtgtccccctacttgcctatttgtgggcggtatggccgaactcggggctttcttttctatactgcaggatatgcggaacaccatcatggcgtccaaaacagtcggaactgcagacgagaagctgcgaaagaaaagctcgttctatcaatcttacctgcgcagaacccagtccatgggcattcagttggatcagaggatcatagttatgtttatggtggcctggggcaaggaagctgtagacaatttccacctcggggatgacatggacccagagctgcggtcattagcccaaattctgatcgatcagaaagtgaaggagatcagtaaccaggaacccatgaaactctga

SEQ ID NO: 5912 - RNA, 1290 nt, synthetic construct
  misc_feature 1..1290: note = derived and/or modified CDS sequence (opt3) from SEOV(DN2)__KX289954.1__N
  source 1..1290: mol_type = other RNA
atggccaccatggaggaaatccagagagagattagcgctcacgaaggccaactggtgatagcaaggcagaaggccaaagacgcggagaagcagtacgaaaaagatcccgacgatctcaacaagcgggcccttcatgaccgcgggtccgtcgctgcatctatccagtcaaaaattgatgagctgaagcgacaattggccgaccgtatcgctgcaggaaagaatattggtcaggatagagaccctacaggcgttgagccaggggatcacttaaaagaaaggagtgccctgagctatggaaacactctagacctcaattccctggatatcgacgagccgacgggccagaccgctgattggcttacaataatcgtgtacctgacttctttcgtagtgcccattatcttgaaggccctctatatgctgaccacacggggtcgccagacctcgaaagacaacaaggggatgagaattaggtttaaagacgattcaagctacgaagacgtcaatggaatccggaagcctaagcatctgtatgtgagtatgccaaacgcgcaatcctctatgaaagcagaggagataactcccggccgcttccgaacagccgtttgcggcctctaccctgctcagattaaggccagaaatatggtgagcccagtcatgtccgtggtagggtttttagcactggctaaagattggacctcaaggatcgaagagtggcttggagaaccctgtaagttcatggccgagagtcctattgcgggtagcttgtctggcaacccagttaatcgggactatatccgtcagcgccagggggccctggcaggaatggaaccgaaagagtttcaagctctaagacagcactccaaggatgccggctgcacgctcgtggagcatatcgaatcacccagcagtatttgggtcttcgctggtgcccctgacaggtgtccacccacttgcctgtttgtcgggggaatggcagagcttggcgtgttcttttctatactgcaggatatgcggaacaccatcatggcctccaaaacagtgggcactgctgacgaaaagttgcgaaagaaaagctcgttctaccaatcttacctccgcagaacccagtccatggggattcagctggatcagaggatcatagttatgtttatggtggcgtggggaaaggaggcagtagacaatttccacttaggtgatgacatggaccctgaactgcggtcactcgcccaaattcttatcgatcagaaagtgaaggagatcagtaaccaggagccaatgaaactgtga

SEQ ID NO: 5913 - RNA, 1290 nt, synthetic construct
  misc_feature 1..1290: note = derived and/or modified CDS sequence (opt3) from SEOV(IR162)__KX079476.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttgacacgccctgtaagttcatggtggagagtcctattgctgggagcttgtctggaaacccagtcaatcgggattatatccgtcagcgccagggtgccctggcgggcatggaaccgaaagagtttcaagccctaagacagcactccaaggacgcagggtgcactctcgtggagcatatcgaatcacccagcagtatttgggtgttcgctggagcccctgataggtgtccacctacctgcctgtttgtcggcggtatggctgagcttggggccttcttttctatactgcaggacatgcggaacacaatcatggcatccaaaactgttggaaccgccgatgaaaagttgcgaaagaaaagctcgttctaccaatcttacctccgcagaacacagtccatgggcattcagctggaccagaggatcatagtgatgtttatggtagcttggggcaaggaggcggtggataatttccacttaggggacgacatggatcccgaactgcggtcactcgcacaaattcttatcgaccagaaagtcaaggagatcagtaaccaggagccaatgaaactgtga

SEQ ID NO: 5914 - RNA, 1290 nt, synthetic construct
  misc_feature 1..1290: note = derived and/or modified CDS sequence (opt3) from SEOV(Gou3)__AF184988.1__N
  source 1..1290: mol_type = other RNA
atggccaccatggaggaaatccagagagagattagcgctcacgaaggccaactggtgatagcaaggcggaaggtcaaagacgccgagaagcagtacgaaaaagatcccgacgatctcaacaagcgcgcgcttcatgaccgagagtccgttgctgcctctatccagtcaaaaattgatgagctgaagcgtcagttggcagacagaatcgccgctgggaagaatattggacaagatagggaccctacaggtgtggaaccaggcgatcacttaaaagagcggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacgcggcagacagacctcgaaagacaacaagggtatgaggattcggtttaaagacgattcaagctacgaggacgtgaatgggatccgcaagcctaagcatctgtatgttagtatgccaaacgcccagtcctctatgaaagcggaggaaataactcccggacgattcagaacagcagtgtgcggcctctaccctgcccaaattaaggctaggaatatggtcagcccagtgatgtccgtagttggctttttagccctggcaaaagattggacctcacggatcgaggactggcttggggctccctgtaagttcatggccgaaagtcctattgcgggtagcttgtctggaaacccagtgaatcgtgattatatccgccagagacagggcgccctggcagggatggagccgaaagaatttcaggctctaaggcaacactccaaggacgccggatgcacgctcgtcgagcatatcgagtcacccagcagtatttgggtgttcgctggcgcccctgatcggtgtccacccacttgcctgtttgtgggtgggatggcagaacttggagccttctttttcatactgcaggacatgcgaaacaccatcatggcttctaaaacagtcggcactgcggatgagaagttgcgcaagaaatccagcttttaccagtcgtacctcagaaggacccaatctatgggcattcagctggaccagcggatcatagttatgttcatggtggcatgggggaaggaagccgtagataattttcacttaggagacgacatggatcctgagctgcgctccctcgctcagattcttatcgaccaaaaagtgaaggaaatctcaaaccaggagccaatgaaactgtga

SEQ ID NO: 5915 - RNA, 1290 nt, synthetic construct
  misc_feature 1..1290: note = derived and/or modified CDS sequence (opt3) from SEOV(Gou3-v9)__AF288651.1__N
  source 1..1290: mol_type = other RNA
atggccaccaaggaggaaatccagagagagattagcgctcacgaaggccaactggtgatagcaaggcagaaagtcaaggacgccgagaaacagtacgaaaaggatcccgacgttctcaacaaacgggcgcttcatgatcgcgagtccgtggctgcctctatccagtcaaagattgacgagctgaagcgacaattggcagatcgtatcgccgctgggaaaagtattggacaggacagagatcctacaggtgtagaaccaggcgaccacttaaaggagaggagcgcactgtcctatgggaatactctagatctcaactctctggacatcgatgaaccgacgggacagaccgccgactggcttacaataatcgtgtacctgacttcgttcgtcgtgcccattatcttgaaagctctctatatgctgaccacacggggccgccagacctcaaaggataatagaggtatgaggattcggtttaaagacgacagcagttacgaggatgttaacgggatccgcaagcctaagcatctgtatgtgtccatgccaaatgcccaatctagcatgaaagcggaggaaataactcccggacgattcagaacagcagtctgcggcctctaccctgcccagattaaggctaggaacatggtgtccccagtaatgtcagttgtgggctttttagccctggcaaaagactggaccagtcggatcgaggattggcttggggctccctgtaagttcatggccgaaagccctattgcgggatctttgtccggtaatccagtcaaccgtgactatatccgccagagacagggcgccctggcagggatggagccgaaagaatttcaagctctaaggcagcactcaaaggatgccggatgcacgctcgtggagcatatcgagagccccagttctatttgggtgttcgctggcgcccctgaccggtgtccacccacttgcctgtttgtcggtgggatggcagaacttggagccttcttttccatactgcaggatatgcgaaataccatcatggctagcaaaacagttggcactgcggacgagaagttgcgcaagaaatcgtctttctaccaatcctacctcagaaggacccagtcaatgggcattcagctggatcagcggatcatagtgatgtttatggtagcatgggggaaggaagccgtggacaacttccacttaggagatgacatggaccctgagctgcgcagtctcgctcaaattcttatcgatcagaaagtcaaggaaatcagcaatcaggagccaatgaaactgtga

SEQ ID NO: 5916 - RNA, 1290 nt, synthetic construct
  misc_feature 1..1290: note = derived and/or modified CDS sequence (opt3) from SEOV(IR461)__AF329388.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtattagaatcaggtttaaagacgattcaagctacgagaatgtgaacgggatacggaagcctaagcatctgtatgttagtatgccaaatgcccaatcctctatgaaagcggaggaaattactcccggacgcttccgaacagcagtgtgcggcctctaccctgcccagatcaaggctggcaacatggtcagcccagtgatgtccgtagttgggtttttagccctggcaaaagactggacctcaagaattgaggaatggcttgatacgccctgtaagttcatggtggagagtcctatcgctggtagcttgtctggaaatccagtcaacagggactatatccggcagcgtcagggcgccctggcggggatggaaccgaaagagtttcaagccctacgccagcactccaaggatgcaggatgcactctcgtggagcatattgaatcacccagcagtatatgggtgttcgctggcgcccctgacagatgtccacctacctgcctgtttgtcggtgggatggctgagcttggagccttcttttctatcctgcaggatatgaggaatacaattatggcatccaaaactgttggcaccgccgacgaaaagttgcggaagaaaagctcgttctaccaatcttacctccgacgcacacagtccatgggcatccagctggatcagagaataattgtgatgtttatggtagcttgggggaaggaggcggtggacaacttccacttaggagatgacatggaccccgaactgaggtcactcgcacaaatccttatcgatcagaaagtcaaggagattagtaatcaggagccaatgaaactgtga

SEQ ID NO: 5917 - RNA, 1290 nt, synthetic construct
  misc_feature 1..1290: note = derived and/or modified CDS sequence (opt3) from SEOV(JUN5-14)__DQ217791.1__N
  source 1..1290: mol_type = other RNA
atggccaccatggaggaatttcagagagagatcagcgctcacgaaggccaactggtgattgcaaggcagaaggtcaaagacgccgagaagcagtacgaaaaagatcccgacgatctcaacaagcgggcgcttcatgaccgcgagtccgttgctgcctctatacagtcaaaaatcgatgagctgaagcgacaattggcagaccgtattgccgctgggaagaatatcggacaggatagagaccctacaggtgtggaaccaggcgatcacttaaaagagaggagtgcactgagctatgggaacactctagacctcaattccctggatattgacgaaccgacgggacagaccgccgattggcttacaatcatagtatacctgacttcttttgtggtccccatcattttgaaggctctctatatgctgaccacacggggccgccagacctcgaaagacaacaagggtatgagaatcaggttcaaagacgattcaagctacgaggacgtgaatgggattcggaagcctaagcatctgtatgttagtatgccaaacgcccaatcctctatgaaagcggaggaaatcactcccggacgctttcgaacagcagtgtgcggcctctaccctgcccagataaaggctagaaatatggtcagcccagtgatgtccgtagttggcttcttagccctggcaaaagattggacctcaaggattgaggaatggcttggggctccctgtaagtttatggccgagagtcctatcgcgggtagcttgtctggaaacccagtgaatcgggactatattcgtcagcgccagggcgccctggcagggatggaaccgaaagagttccaagctctaagacagcacgccaaggatgctggatgcacgctcgtcgagcatatcgaatccccctcaagcatctgggtgtttgccggcgcacctgacaggtgtccacccacttgcctgttcgtgggtgggatggccgagcttggagctttcttcagtattctgcaggatatgcggaacaccataatggcgtctaaaacagtcggcactgcagacgaaaagttgcgaaagaaatccagcttttaccaatcgtacctccgcagaacccagtctatgggcatccagctggatcagaggattatcgttatgttcatggtggcctgggggaaggaggctgtagacaattttcacttaggagatgacatggaccctgaactgcggtccctcgcccaaatacttattgatcagaaagtgaaggagatctcaaaccaggagccaatgaaactgtga

SEQ ID NO: 5918 - RNA, 1290 nt, synthetic construct
  misc_feature 1..1290: note = derived and/or modified CDS sequence (opt3) from SEOV(L99)__AF488708.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcggacacttcatgaccgcgagtccgttgcggcttctatccagtcaaaaattgatgagctgaagcgacaattggccgaccgtatcgcagccgggaagaatattggacaggatagagaccctactggtgtggaaccaggcgatcacttaaaagagaggagtgctctgagctatgggaacacgctagacctcaattccctggatatcgacgaaccgaccggacagacagcagattggcttactataatcgtatacctgacctctttcgtggtccccattatcttgaaggccctctatatgctgacaacccggggccgccagacttcgaaagacaacaagggtatgagaattaggtttaaagacgattcaagctacgaggacgtgaatgggatccggaagcctaagcatctgtatgttagtatgccaaacgctcaatcctctatgaaagccgaggaaataacacccggacgcttccgaaccgcggtgtgcggcctctaccctgcacagattaaggccagaaatatggtcagcccagtgatgtccgtagttggctttttagctctggccaaagattggacgtcaaggatcgaggaatggcttggggcaccctgtaagttcatggctgagagtcctattgccggtagcttgtctggaaacccagtgaatcgggactatatccgtcagcgccagggcgcgctggccgggatggaaccgaaagagtttcaagcactaagacagcacgctaaggatgccggatgcactctcgtcgagcatatcgaatccccctcaagcatttgggtgttcgctggcgcccctgacaggtgtccacctacctgcctgtttgtgggtgggatggcagagcttggagccttctttagtatactgcaggatatgcggaacacaatcatggcttctaaaactgtcggcaccgcggacgaaaagttgcgaaagaaatccagcttctaccaatcgtacctccgcagaacacagtctatgggcattcagctggatcagaggatcatagttatgtttatggtggcatgggggaaggaggccgtagacaatttccacttaggagatgacatggaccccgaactgcggtccctcgctcaaattcttatcgatcagaaagtgaaggagatctcaaaccaggagccaatgaaactgtga

SEQ ID NO: 5919 - RNA, 1290 nt, synthetic construct
  misc_feature 1..1290: note = derived and/or modified CDS sequence (opt3) from SEOV(R22)__AF488707.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttggggctccctgtaagttcatggccgagagtcctattgcgggtagcttgtctggaaacccagtgaatcgggactatatccgtcagcgccagggcgccctggcagggatggaaccgaaagagtttcaagctctaagacagcacgccaaggatgctggatgcacgctcgtcgagcatatcgaatccccctcaagcatttgggtgttcgccggcgcacctgacaggtgtccacccacttgcctgtttgtgggtcggatggccgagcttggggctttctttagtatactgcaggatatgaaaaacaccatcatggcgtctaagacagtcggaactgcagacgaaaagttgcgcaaaaagtccagcttctaccaatcgtacctccgaagaacccagtctatgggcattcagctggatcagaggatcatagttatgtttatggtggcctggggcaaagaggctgtagacaatttccacttaggggatgacatggaccctgaactgcggtccctcgcccaaattcttatcgatcagaaggtgaaagagatctcaaaccaggagccaatgaagctgtga

SEQ ID NO: 5920 - RNA, 1290 nt, synthetic construct
  misc_feature 1..1290: note = derived and/or modified CDS sequence (opt3) from SEOV(TURCKHEIM/Hu/FRA/2016/2016.00044)__KX064270.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtatcgccgctgggaagaatattggacaggatagagaccctacaggtgtggaaccaggcgatcacttaaaagagaggagtgcactgagctatgggaacactctagacctcaattccctggatatcgacgaaccgacgggacagaccgccgattggcttacaataatcgtatacctgacttctttcgtggtccccattatcttgaaggctctctatatgctgaccacacggggccgccagacctcgaaagacaacaagggtatgagaattaggtttaaagacgattcaagctacgaggacgtgaatgggatccggaagcctaagcatctgtatgttagtatgccaaacgcccaatcctctatgaaagcggaggaaataactcccggacgcttccgaacagcagtgtgcggcctctaccctgcccagattaaggctagaaatatggtcagcccagtgatgtccgtagttggctttttagccctggcaaaagattggacctcaaggatcgaggaatggcttgacgctccctgtaagttcattgccgagagtcctatcgcggggagcttgtctggaaacccagtgaatcgggattatatccgtcagcgccagggtgccctggcaggcatggaaccgaaagagtttcaagctctaagacagcactccaaggacgccgggtgcacgctcgtcgagcatattgaatcacccagcagtatatgggtgttcgctggagcccctgataggtgtccacccacttgcctgtttgtgggcggtatggcagagcttggggccttcttttctatcctgcaggacatgcggaacaccattatggcttccaaaacagtcggaactgcggatgaaaagttgcgaaagaaaagctcgttctaccaatcttacctccgcagaacccagtccatgggcatccagctggaccagaggataattgttatgtttatggtggcatggggcaaggaggccgtagataatttccacttaggggacgacatggatcctgaactgcggtcactcgctcaaatccttatcgaccagaaagtgaaggagattagtaaccaggagccaatgaaactgtga

SEQ ID NO: 5921 - RNA, 1290 nt, synthetic construct
  misc_feature 1..1290: note = derived and/or modified CDS sequence (opt3) from SEOV(Z37)__AF187082.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatttcaacaagcgggcgctccatgaccgcgagtccgttgctgcctctatccagtcaaaaattgatgagcttaagcgacaactggcagaccgtatcgccgctgggaagaatattggacaggatagagaccctacaggtgtggaaccaggcgatcacttgaaagagaggagtgcattaagctatgggaacactctggacctaaattccctcgatatcgacgaaccgacgggacagaccgccgattggctgacaataatcgtataccttacttcttttgtggtccccattatcctgaaggctttgtatatgctcaccacacggggccgccagacctcgaaagacaacaagggtatgagaattaggttcaaagacgattcaagctacgaggacgtgaatgggatccggaagcctaagcatctgtatgttagtatgccaaacgcccaatcctctatgaaagcggaggaaataactcccggacgctttcgaacagcagtgtgcggcctgtaccctgcccagattaaggctagaaatatggtcagcccagtgatgtccgtagttggcttcctcgccttagcaaaagattggacctcaaggatcgaggaatggctgggggctccctgtaagtttatggccgagagtcctattgcgggaagcctttctggtaacccagtgaatcgggactatatccgtcagcgccagggcgccttggcagggatggaaccgaaagagttccaagctctgagacagcacgccaaggatgctggatgcacgctagtcgagcatatcgaatccccctcaagcatttgggtgtttgccggcgcacctgacaggtgtccacccacttgcctcttcgtgggtgggatggccgagctgggagcgtttttcagtatacttcaggatatgcggaacaccatcatggcttctaaaacagtcggcactgcagacgaaaagctgcgaaagaaatccagcttttaccaatcgtacttgcgcagaacccagtctatgggcattcagctcgatcagaggatcatagggatgttcatggttgcctggggaaaggaggctgtggacaattttcacctgggtgatgacatggaccctgaattacggtccctggcccaaattctcatcgatcagaaagtaaaggagatctcaaaccaggagccaatgaaactttga

SEQ ID NO: 5922 - RNA, 1290 nt, synthetic construct
  misc_feature 1..1290: note = derived and/or modified CDS sequence (opt3) from SEOV(Tchoupitoulas (TCH))__AF329389.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatttctataagcgggcgctccatgaccgcgagtccgttgctgcctctatccagtcaaaaattgatgagcttaagcgacaactggcagaccgtatcgccgctgggaagaacattggacaggatagagaccctacaggtgtggaaccaggcgatcacttgaaagagaggagtgcattaagctacgggaatactctggacctaaactccctcgatatcgacgaaccgacgggacagaccgccgattggctgacaataatcgtatatcttacttcttttgtggtccccattatcctgaaggctttgtacatgctcaccacacggggccgccagacctcgaaagacaataagggtatgagaattaggttcaaagacgattcaagctatgaggacgtgaacgggatccggaagcctaagcatctgtacgttagtatgccaaatgcccaatcctctatgaaagcggaggaaataactcccggacgctttcgaacagcagtgtgcggcctgtatcctgcccagattaaggctagaaacatggtcagcccagtgatgtccgtagttggcttcctcgccttagcaaaagattggacctcaaggatcgaggaatggctgggggctccctgtaagtttatggccgagagtcctattgcgggaagcctttctggtaatccagtgaaccgggactacatccgtcagcgccagggcgccttggcagggatggaaccgaaagagttccaagctctgagacagcactccaaggatgccggatgcacgctagtcgagcatatcgaatcacccagcagtatttgggtgtttgctggcgcccctgacaggtgtccacccacttgcctcttcgtgggtgggatggcagagctgggagcctttttctctatacttcaggatatgcggaataccatcatggcttccaaaacagtcggcactgcggacgaaaagctgcgaaagaaaagctcgttttaccaatcttatttgcgcagaacccagtccatgggcattcagctcgatcagaggatcatagttatgttcatggtggcatgggggaaggaggccgtagacaactttcacctgggagatgacatggaccctgaattacggtcactggctcaaattctcatcgatcagaaagtgaaggagatcagtaatcaggagccaatgaaactttga

SEQ ID NO: 5923 - RNA, 1290 nt, synthetic construct
  misc_feature 1..1290: note = derived and/or modified CDS sequence (opt3) from SEOV__M34881.1__N
  source 1..1290: mol_type = other RNA
atggccaccatggaggaaatccagagagagattagcgctcacgaaggccaactggtgatagcaaggcagaaggtcaaagacgccgagaagcagtacgaaaaagatcccgacgatctcaacaagcgggcgcttcatgaccgcgagtccgttgctgcctctatccagtcaaaaattgatgagctgaagcgacaattggcagaccgtttacagcaggggagaacaagtggacaggatagggaccctactggtgtggaaccaggcgatcacctgaaggagcggagcgccctatcctatgggaatacgctcgacctgaactctcttgatatcgacgaaccgaccggacaaacagctgattggctgactattatcgtatacttgacctcgttcgtggtccccataatcctcaaagcactgtatatgctgacaacccgcggcagacagacttcaaaggacaataaaggtatgaggattcggtttaaggacgatagcagttacgaggacgtgaacgggatccgcaaacctaagcatctctatgtttccatgccaaatgcccagtctagcatgaaggctgaggaaattacacccggacgattcagaaccgccgtgtgcggcttataccctgcgcagatcaaagcaaggaacatggtctccccagtgatgtcagtagttggctttctggcccttgctaaggattggacgagtcggatagaggaatggttgggggccccctgtaaattcatggcagagagcctgattgctggatctctatccggtaatcctgtgaaccgtgactatatccgccaaagacagggcgccctcgcggggatggaaccaaaggagtttcaggccctgaggcaacactcaaaagatgcaggatgcactcttgtcgagcatattgaaagcccgagttctatctgggtgttcgctggcgcccccgaccggtgtcctccaacctgcctgtttgtgggtgggatggctgagttgggagccttcttttccatcctccaggatatgcgaaatacaattatggcaagcaagactgtcggcaccgccgacgaaaaactgcgcaagaagtcgtctttctaccagtcctacttaagaaggacacagtcaatgggcatacaactggatcagcggatcattgttatgtttatggtggcttgggggaaagaggcggtagacaacttccacctcggagatgacatggaccccgaacttcgcagtctggcacagatcttgatagatcagaaggtgaaagagattagcaatcaagagcctatgaagctatga

SEQ ID NO: 5924 - RNA, 1287 nt, synthetic construct
  misc_feature 1..1287: note = derived and/or modified CDS sequence (opt3) from SNV(H10)__NC_005216.1__N
  source 1..1287: mol_type = other RNA
atgagcaccctgaaggaggtgcaggacaacatcacactccacgaacaacagcttgtcactgccagacagaaactgaaggatgctgagagggcagttgaattggaccccgatgacgtgaataaatccacgttacagtctcggcgcgccgcggtatcagctctggagaccaagctaggcgaactcaaacgagagctggccgatcttattgcagcccaaaagctggctagtaagcctgtggacccaacagggatagagccggatgaccatttgaaagaaaagagctccctccgttacggaaacgtcctggatgttaattctatcgacctggaggaaccctcgggtcagactgcagattggaaatcaattggcctctatatcttgagcttcgccctgcctattatccttaaggctttgtacatgctgagtaccagagggaggcagacaataaaagagaacaagggaacccggatccgctttaaggacgattcctcttatgaggaagtgaatggcattagaaaaccaaggcacctatacgtgagcatgcccactgcccagtccacaatgaaggcggacgagatcacccctggtcggttccgcacgattgcatgcgggctctttccagcccaagtcaaagctcgaaacatcatatcacccgtgatgggagtaattggcttcagctttttcgttaaggactggatggaaagaatcgatgactttctggccgcaaggtgtcctttccttccagagcagaaagatccgcgggacgctgccctggcgactaatcgtgcctattttattacccgccagttacaggtggatgaaagtaaggtctctgacatcgaggatctcatcgcagacgctagagccgagtccgctacaattttcgccgatatagcaactccccattcagtgtgggtgtttgcctgcgctcctgacaggtgtccacccaccgcgctgtacgtcgcaggcatgcctgaattaggggccttctttgctatcctgcaagatatgcggaacacaattatggccagcaaaagtgttggaacctctgaggaaaagctcaagaaaaagtccgcattctatcagagctaccttcgacgcacgcagtcgatgggtatccaactggaccagaaaataattatcttgtacatgtctcactggggcagagaggccgtgaatcatttccacctaggggacgatatggacccagaactgagggagctcgctcagactctggtagatatcaaggtgcgggagatttccaaccaggaaccccttaaactgtga

SEQ ID NO: 5925 - RNA, 1287 nt, synthetic construct
  misc_feature 1..1287: note = derived and/or modified CDS sequence (opt3) from SNV(2)__JQ690282.1__N
  source 1..1287: mol_type = other RNA
atgagcaccctgaaggaggtgcaggacaacatcacactccacgaacaacagcttgtcactgccagacagaaactgaaggatgctgagagggcagttgaattggaccccgatgacgtgaataaatccacgttacagtctcggcgcgccgcggtatcagctctggagaccaagctaggcgaactcaaacgagagctggccgatcttattgcagcccaaaagctggctagtaagcctgtggacccaacagggatagagccggatgaccatttgaaagaaaagagctccctccgttacggaaacgtcctggatgttaattctatcgacctggaggaaccctcgggtcagactgcagattggaaatcaattggcctctatatcttaagtttcgccctgcctattatccttaaggctttgtacatgctgagtaccagagggaggcagacaataaaagagaacaagggaacccggatccgctttaaggacgattcctcttatgaggaagtgaatggcattagaaaaccaaggcacctatacgtgagcatgcccactgcccagtccacaatgaaggcggacgagatcacccctggtcggttccgcacgattgcatgcgggctctttccagcccaagtcaaagctcgaaacatcatatcacccgtgatgggagtaattggcttcagctttttcgttaaggactggatggaaagaatcgatgactttctggccgcaaggtgtcctttccttccagagcagaaagatccgcgggacgctgccctggcgactaatcgtgcctattttattacccgccagatgcaagtggatgaaagcaaggtctctgacatcgaggatttgatcgcagacgctagagccgagtccgctacaattttcgccgatatagcaactccccattcagtgtgggtgtttgcctgcgctcctgacaggtgtccacccaccgcgctctacgtcgcaggcatgcctgaactgggggccttctttgctatcttacaggatatgcggaacacaattatggccagcaaaagtgttggaacctctgaggaaaagctgaagaaaaagtccgcattctatcagagctacctccgacgcacgcagtcgatgggtatccaacttgaccagaaaataattatcctgtacatgtctcactggggcagagaggccgtgaatcatttccacttgggggacgatatggacccagaactaagggagctggctcagactctcgtagatatcaaggtgcgggagatttccaaccaggaacccctgaaactttga

SEQ ID NO: 5926 - RNA, 1287 nt, synthetic construct
  misc_feature 1..1287: note = derived and/or modified CDS sequence (opt3) from SNV(3)__JQ690278.1__N
  source 1..1287: mol_type = other RNA
atgagcaccctgaaggaggtgcaggacaacatcacactccacgaacaacagcttgtcactgccagacagaaactgaaggatgctgagagggcagttgaattggaccccgatgacgtgaataaatccacgttacagtctcggcgcgccgcggtatcagctctggagaccaagctaggcgaactcaaacgagagctggccgatcttattgcagcccaaaagctggctagtaagcctgtggacccaacagggatagagccggatgaccatttgaaagaaaagagctccctccgttacggaaacgtcctggatgttaattctatcgacctggaggaaccctcgggtcagactgcagattggaaatcaattggcctctatatcttgagcttcgccctgcctattatccttaaggctttgtacatgctgagtaccagagggaggcagacaataaaagagaacaagggaacccggatccgctttaaggacgattcctcttatgaggaagtgaatggcattagaaaaccaaggcacctatacgtgagcatgcccactgcccagtccacaatgaaggcggacgagatcacccctggtcggttccgcacgattgcatgcgggctctttccagcccaagtcaaagctcgaaacatcatatcacccgtgatgggagtaattggcttcagctttttcgttaaggactggatggaaagaatcgatgactttctggccgcaaggtgtcctttccttccagagcagaaagatccgcgggacgctgccctggcgactaatcgtgcctattttattacccgccagttacaggtggatgaaagtaaggtctctgacatcgaggatctcatcgcagacgctagagccgagtccgctacaattttcgccgatatagcaactccccattcagtgtgggtgtttgcctgcgctcctgacaggtgtccacccaccgcgctgtacgtcgcaggcatgcctgaattaggggccttctttgctatcctgcaagatatgcggaacacaattatggccagcaaaagtgttggaacctctgaggaaaagctcaagaaaaagtccgcattctatcagagctaccttcgacgcacgcagtcgatgggtatccaaccagaccagaaaataattatcctgtacatgtctcactggggcagagaggccgtgaatcatttccacttgggggacgatatggaccccgaactaagggagctggctcagactctcgtagatatcaaggtgcgggagatttccaaccaggaaccgctgaaactttga

SEQ ID NO: 5927 - RNA, 1287 nt, synthetic construct
  misc_feature 1..1287: note = derived and/or modified CDS sequence (opt3) from SNV(CC107/POR)__KT885046.1__N
  source 1..1287: mol_type = other RNA
atgagcaccctgaaggaggtgcaggacaacatcacactccacgaacaacagcttgtcactacgagacagaaactgaaggatgccgagagggctgttgaattggaccccgatgacgtgaataaatccaccttacagtctcggcgcgcagccgtatcagcgctggagacaaagctaggcgaactcaaacgagagctggctgatcttattgccgcacaaaagctggccagtaagcctgtggacccaactgggatagagccggatgaccatttgaaagaaaagagctccctccgttacggaaacgtcctggatgttaattctatcgacctggaggaaccctcgggtcagaccgctgattggaaatcaattggcctctatatcttaagtttcgcactgcctattatccttaaggccttgtacatgctgagtacaagagggaggcagaccataaaagagaacaagggaactcggatccgctttaaggacgattcctcttatgaggaagtgaatggcattagaaaaccaaggcacctatacgtgagcatgcccacagctcagtccaccatgaaggccgacgagatcacgcctggtcggttccgcactattgcgtgcgggctctttccagcacaagtcaaagcccgaaacatcatatcacccgtgatgggagtaattggcttcagctttttcgttaaggactggatggaaagaatcgatgagtttctggctgccaggtgtcctttccttccagaacagaaagacccgcgggatgcagctctggccaccaatcgtgcgtattttattacacgccagatgcaagtggacgagagcaaggtctctgatatcgaggacttgatcgccgatgcaagagctgaatccgccactattttcgctgacatagccacaccccattcagtgtgggtgtttgcatgcgcccctgataggtgtccacccaccgctctctacgtcgcgggcatgcctgagctgggggcattctttgccatcttacaggacatgcggaacaccattatggctagcaaaagtgttggaacgtctgaagagaagctgaagaaaaagtccgccttctatcagagctacctccgacgcactcagtcgatgggtatccaacttgatcagaaaataattatcctgtacatgtctcactggggcagagaagcagtgaatcatttccacttgggggacgacatggatccagagctaagggagctggcccagacactcgtagacatcaaggtgcgggaaatttccaaccaggagcccctgaaactttga

SEQ ID NO: 5928 - RNA, 1287 nt, synthetic construct
  misc_feature 1..1287: note = derived and/or modified CDS sequence (opt3) from HPS(Convict Creek 107)__L33683.1__N
  source 1..1287: mol_type = other RNA
atgagcaccctgaaggaggtgcaggacaacatcacactccacgaacaacagcttgtcactacgagacagaaactgaaggatgccgagagggctgttgaattggaccccgatgacgtgaataaatccaccttacagtctcggcgcgcagccgtatcagcgctggagacaaagctaggcgaactcaaacgagagctggctgatcttattgccgcacaaaagctggccagtaagcctgtggacccaactgggatagagccggatgaccatttgaaagaaaagagctccctccgttacggaaacgtcctggatgttaattctatcgacctggaggaaccctcgggtcagaccgctgattggaaatcaattggcctctatatcttaagtttcgcactgcctattatccttaaggccttgtacatgctgagtacaagagggaggcagaccataaaagagaacaagggaactcggatccgctttaaggacgattcctcttatgaggaagtgaatggcattagaaaaccaaggcacctatacgtgagcatgcccacagctcagtccaccatgaaggccgacgagatcacgcctggtcggttccgcactattgcgtgcgggctctttccagcacaagtcaaagcccgaaacatcatatcacccgtgatgggagtaattggcttcagctttttcgttaaggactggatggaaagaatcgatgagtttctggctgccaggtgtcctttccttccagaacagaaagacccgcgggatgcagctctggccaccaatcgtgcgtattttattacacgccagatgcaagtggacgagagcaaggtctctgatatcgaggacttgatcgccgatgcaagagctgaatccgccactattttcgctgacatagccacaccccattcagtgtgggtgtttgcatgcgcccctgataggtgtccacccaccgctctctacgtcgcgggcatgcctgagctgggggcattctttggaatcttacaggacatgcggaacaccattatggccagcaaaagtgttggtacgtctgaagagaagctgaagaaaaagtccgctttctatcagagctacctccgacgcactcagtcgatgggcatccaacttgatcagaaaataattatcctgtacatgtctcactgggggagagaagccgtgaatcatttccacttgggagacgacatggatccagagctaagggagctggcacagacactcgtagacatcaaggtgcgggaaatttccaaccaggagcccctgaaactttga

SEQ ID NO: 5929 - RNA, 1287 nt, synthetic construct
  misc_feature 1..1287: note = derived and/or modified CDS sequence (opt3) from HPS(Convict Creek 74)__L33816.1__N
  source 1..1287: mol_type = other RNA
atgagcaccctgaaggaggtgcaggacaacatcacactccacgaacaacagcttgtcacttccagacagaaactgaaggatgccgagagggctgttgaattggaccccgatgacgtgaataaatctacgttacagtcacggcgcgcagccgtaagtgcgctggagaccaagctaggcgaactcaaacgagagctggctgatcatattgccgcacaaaagctggccagcaagcctgtggacccaacagggatagagccggatgaccacctgaaagaaaagtcctctttgcgttacggaaacgtcctcgatgtgaatagtatcgacctggaggaacccaacggtcagactgctgattggaaatcaattggcctgtatatcctcagcttcgcattacctattatcctgaaggccctttacatgttgagtaccagagggaggcagacaataaaagagaataagggaacccggatccgctttaaggacgattcctcttatgaggaagttaacggcattagaaaaccaaggcatctgtacgtgagcatgcccactgctcagtccacaatgaaggccgacgagatcacccctggtcggttccgcacgattgcgtgcgggctatttccagcacaagtcaaagcccgaaatatcatatcacccgtgatgggagtaattggcttctcgtttttcgttaaggactggatggaaagaatcgatgagtttctcgctgccaggtgtcctttcctgccagaacagaaagacccgcgggatgcagctcttgccactaaccgtgcgtattttattacccgccagcttcaggtggacgagagcaaggtctctgatatcgaggacttgatcgccgatgcaagagctgaatccgccacaattttcgctgacatagccactccccactcagtgtgggtgtttgcatgcgcccctgataggtgtccacccaccgctctctacgtcgcgggcatgcctgagctgggggcattctttggaatcttacaagacatgcggaatacaattatggccagcaaaagtgttggtacctctgaagagaagctgaagaaaaagtccgctttctatcagagctacctccgacgcacgcagtcgatgggcatccaacttgatcagaaaataattatcctgtacatgtctcattgggggagagaagccgtgaaccacttccacttgggagacgacatggatccagagctaagggagctggcacagactctcgtagacatcaaggtgcgggaaatttccaatcaggagcccctgaaactttga

SEQ ID NO: 5930 - RNA, 1287 nt, synthetic construct
  misc_feature 1..1287: note = derived and/or modified CDS sequence (opt3) from HPS(H-NY1)__U47135.1__N
  source 1..1287: mol_type = other RNA
atgagcaccctgaaggaggtgcaggacaacatcacactccacgaacaacagcttgtcactgccagacagaaactgaaggatgctgagaaagcagttgaagtggaccccgatgacgtaaataagtccacgttgcagggcaggcgggccgcggtgtctgctttagagaccaaactgggggaactaaagcgccaactcgccgatctgattgcagcccagaaacttgcttcaaagcctatagacccaacaggaatcgagccggatgaccatctgaaggagaaaagtagcttgcgatacggtaacgtcctcgatgttaattccattgacctggaagaaccctctggccagactgcagattggaaggccatcgggatgtatattctgtcgttcgctatccctataatcctcaaagccttatacatgctgtcaacccgtggaagacagacagtgaaggaaaacaagggcaccaggattcggtttaaagacgatagcagttatgaggaggtgaatggtatccgcaagccaagacacctttacgtctccatgcccactgcgcaatctacaatgaaagcagacgaaattacccctgggaggttccggacgatcgcctgcggattgtttccagctcaggtgaaggcccgcaacataattagccccgtaatgggcgttatcggcttcaactttttcgtgaaagactggatggatcgaattgacgattttctggcagagagatgtcctttcctaccagaaccgagggaccccaaggatgctgccctcgggactaatcgggcgtattttatcacccgtcaggcccaggtcgacgagtccaaagtggtggatatcgaggagctgattgtcgacgcacgcgctgagtcagccacacttttcactgatatagctacccctcatagtgtttgggtgtttgcctgcgcaccagacagatgtccccctacagccctgtacgtagctggaatgccagaattgggtgcgttctttgcaatcctccaagatatgaggaataccattatggccagcaagtctgtgggcacggctgaggaaaagctgaaaaagaaatccgccttctatcagtcatacttacggcgaactcagagcatggggatccaactggaccagaagataattatcctctacatgatccactggggaaaagaggcagtcaaccatttccaccttggcgacgatatggaccccgaactgcgcgagttggcccaggctctagtggatgccaaggttaaggagattagtaatcaggaaccgctgaaactctga

SEQ ID NO: 5931 - RNA, 1290 nt, synthetic construct
  misc_feature 1..1290: note = derived and/or modified CDS sequence (opt3) from THAIV(Nakhon Ratchasima/Bi0017/2004)__AM397664.1__N
  source 1..1290: mol_type = other RNA
atggccaccatggaggaactgcagagagagatcaacgctcacgaaggccaactcgtggtcgcaaggcagaaggttaaagacgccgagaagcagtacgaaaaagatcccgacgatcttaatcggcgcgcgctgcatgaccgagagagcgtggctgcctccattcagtctaagatagatgagttgaaacgtcaattagcagacagaatcgcctcagggaggacaattggacaggatcgggaccctactggtgtagaaccaggcgatcatctgcgcgagagaagtatgctaagctatgggaacgtgctcgacctgaataaccttgatatcgaggaaccgacgggacagaccgctgactggctgacaattatcgtctacttgacttccttcgtgatacccatcattctcaaggcactgtatatgctgaccacaaggggccggcagaccactaaggataataaaggtatgcgcatccgatttaaggacgactcttcgtacgaggatgttaacgggattagaaaacctaagcacctctatatctcaatgccaaatgcccaaagcagtatgaaagctgaagagataacacccggaaggttccggaccgccgtgtgcggcttataccctgcgcaggtcaaggcacgtaacatggtgtccccagtaatgtctgttattggctttatggccctggctaaggactggacggatcgcatccaggactggcttggggccccctgtaaattcttgcctgatctgagcactcagtccctacacgcatcaccaccgaccaatgctgactatattgcccaaagacagggactcctggcgggtatggaaacaaaggagagtaaaggcatcagggatcatgcccgggacgcagggtgcactcttgtggatcacctggacagcccctcttccatctgggtctttgctggagcccctgatcgatgtccacctacctgcttgttcattgctggcatggccgaactcggtgcatttttctcaatactgcaggacatgcgcaacacaatcatggccagcaagaccgtggggacgagtgaggagaaattaaagaaaaagtcttccttttaccaaagctacctgagaaggactcagtcgatgggcattcagctcgaccagcggatcatagtgatgttcatggtcgcttggggaaaggaagcggttgataattttcaccttggcgacgatatggaccccgagctgcgcaacttggcacaactactgattgatcagaaagtgaaggaaatctctaatcaggagccactcaaactgtga

SEQ ID NO: 5932 - RNA, 1290 nt, synthetic construct
  misc_feature 1..1290: note = derived and/or modified CDS sequence (opt3) from TULV(Tula/Moravia/5302Ma/94)__NC_005227.2__N
  source 1..1290: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcgcgccgcggtgtcagctctggaggacaaattggccgatttcaagcgacagttagcagacctggtaagtagccagaagatgggcgagaaacctgtggatccaacggggctagaaccggacgatcatctcaaggagcgttcctctctgagatacggaaatgtccttgacgtgaacgccattgatatcgacgaaccctcgggtcagaccgctgattggttttcaattggccaatatatcacagggttcgcactggccataatcttgaaagctctctacatgctgagcactaggggacggcagaccattaaggagaataaaggcacacgcatcagatttaaggacgacagttcctatgaggaaattaacggtatcaggcggcctaagcacctgtacgtttctatgccaaccgcccagagcactatgaaagcggatgagctcacacccgggcgcttccgaaccatagtgtgcggattatttcctgcacagattatgcatagaaatatcatttccccagtcatgggcgtgatcggcttctcatttttcgtaaaggactggcccgagaaaatcgaagaatttctgattaagccttgtccattccttaaaaagagtgggccgagcaaagaggaggactttttggtttctaacgatgcctatctgctaggaagggaaaaggctctccgggagtcccacctggccgaaatagatgaccttatcgatctggcagcttcaggtgaccccacgcctccagatagcattaagagtccccaagccccttgggtgttcgcgtgccgtccagaccgctgtcccccgacttgcatctacatagccggcatggcagagttgggggcctttttctctattctccaggatatgagaaataccatcatggcttccaaaacagtcggaactgctgaagagaagctgaaaaagaaaagctcgttctatcagtcttacttaaggcggacccaatccatgggcatccagctggaccagcgaattatcctcctttttatgacagagtggggttcagacattgtgaaccatttccacctgggggatgacatggatcctgaattgcgcaccctagcccagagtctgatagaccaaaaggtgaaggagatcagcaatcaggaacccctcaaaatttga

SEQ ID NO: 5933 - RNA, 1293 nt, synthetic construct
  misc_feature 1..1293: note = derived and/or modified CDS sequence (opt3) from TULV(D17-98)__AF289820.1__N
  source 1..1293: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcgcgccgcggtgtcagctctggaggacaaattggccgatttcaagcgacagttagcagacctggtaagtagccagaagatgggcgagaaacctgtggatccaacggggctagaaccggacgatcatctcaaggagcgttcctctctgagatacggaaatgtccttgacgtgaacgccattgatatcgacgaaccctcgggtcagaccgctgattggttttcaattggccaatatatcatagggttcgcactggccatcgttttgaaagctctctacatgctgagcacaaggggacggcagactattaaggagaataaaggcacccgcatcagatttaaggacgacagttcctatgaggaaattaacggtatcaggcggcctaagcacctgtacgtgtctatgccaacagcccagagcaccatgaaagcggatgagctcactcccgggcgcttccgaacaatagtctgcggattatttcctgcacagattatgcatagaaatatcatttccccagtgatgggcgtaatcggcttctcatttttcgttaaggactggcccgataaaatcgaagagtttctgattaagccttgtccattccttaaaaagcaagggggaccgaacaaagacgaagagtttttggtgagttatgatgcctacctgctaggtagggagaaggctctccgggaaagccacctggccgagatagacgatcttatcgacctggcagcttctggcgatcccacccctccagactccattaagtcaccccaggggccttgggtcttcgcctgcgcgccagatcgttgtcccccgacgtgcatctatgtggccggaatggcagaattgggcgcctttttcagcatactccaggacatgcgcaatactattatggctagtaaaaccgtgggtacagctgaggaaaagctgaaaaagaaatcttccttctaccaaagctacttaagaaggactcagtcgatggggatccagctggaccagcggatcattctcctttttatgatggagtggggatctgatatcgtcaaccatttccacctgggcgacgatatggaccctgagttgcgaaccctagcccaatccctgattgatcagaaggttaaggaaatatcaaatcaggagcccctcaaaatctga

SEQ ID NO: 5934 - RNA, 1293 nt, synthetic construct
  misc_feature 1..1293: note = derived and/or modified CDS sequence (opt3) from TULV(D5-98)__AF289819.1__N
  source 1..1293: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcgcgccgcggtgtcagctctggaggacaaattggccgatttcaagcgacagttagcagacctggtaagtagccagaagatgggcgagaaacctgtggatccaacggggctagaaccggacgatcatctcaaggagcgttcctctctgagatacggaaatgtccttgacgtgaacgccattgatatcgacgaaccctcgggtcagaccgctgattggttttcaattggccaatatatcatagggttcgcactggccatcgttttgaaagctctctacatgctgagcacaaggggacggcagactattaaggagaataaaggcacccgcatcagatttaaggacgacagttcctatgaggaaattaacggtatcaggcggcctaagcacctgtacgtgtctatgccaacagcccagagcaccatgaaagcggatgagctcactcccgggcgcttccgaacaatagtctgcggattatttcctgcacagattatgcatagaaatatcatttccccagtgatgggcgtaatcggcttctcatttttcgttaaggactggcccgataaaatcgaagagtttctgattaagccttgtccattccttaaaaagcaagggggaccgaacaaagacgaagagtttttggtgagttatgatgcctacctgctaggtagggagaaggctctccgggaaagccacctggccgagatagacgatcttatcgacctggcagcttctggcgatcccacccctccagactccattaagtcaccccaggccccttgggtcttcgcgtgcgccccagatcgttgtcccccgacgtgcatctatgtggcagggatggctgaattgggagcctttttcagcatactccaggacatgcgcaatactattatggctagtaaaaccgtgggcacagccgaggaaaagctgaaaaagaaatcttccttctaccaaagctacttaagaaggactcagtcgatgggtatccagctggaccagcggatcattctcctttttatgatggagtgggggtctgatatcgtcaaccatttccacctgggagacgatatggaccctgagttgcgaaccctagcacaatccctgattgatcagaaggttaaggaaatatcaaatcaggagcccctcaaaatctga

SEQ ID NO: 5935 - RNA, 1293 nt, synthetic construct
  misc_feature 1..1293: note = derived and/or modified CDS sequence (opt3) from TULV(D63-98)__AF289821.1__N
  source 1..1293: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcgcgccgcggtgtcagctctggaggacaaattggccgatttcaagcgacagttagcagacctggtaagtagccagaagatgggcgagaaacctgtggatccaacggggctagaaccggacgatcatctcaaggagcgttcctctctgagatacggaaatgtccttgacgtgaacgccattgatatcgacgaaccctcgggtcagaccgctgattggttttcaattggccaatatatcatagggttcgcactggccatcgttttgaaagctctctacatgctgagcacaaggggacggcagactattaaggagaataaaggcacccgcatcagatttaaggacgacagttcctatgaggaaattaacggtatcaggcggcctaagcacctgtacgtgtctatgccaacagcccagagcaccatgaaagcggatgagctcactcccgggcgcttccgaacaatagtctgcggattatttcctgcacagattatgcatagaaatatcatttccccagtgatgggcgtaatcggcttctcatttttcgttaaggactggcccgataaaaaggaagagtttctgatcaaaccttgtccattccttaagaaacaagggggaccgaacaaggacgaagagtttttggtgagtaatgatgcctatctgctaggtagggagaaggctctccgggaaagccacctggccgagattgacgatcttatagacctggcagcttctggcgatcccacccctccagactccatcaaatcaccccaggggccttgggtcttcgcctgcgcgccagatcgttgtcccccgacgtgcatttacgtggccggaatggcagaattgggcgcctttttcagcatcctccaggacatgcgcaacactataatggctagtaagaccgtgggtacagctgaggaaaaactgaagaaaaagtcttccttctatcaaagctacttaagaaggactcagtcgatggggattcagctggaccagcggatcatcctcctttttatgatggagtggggatctgatattgtcaatcatttccacctgggcgacgatatggaccctgagttgcgaaccctagcccaatccctgatcgatcagaaggttaaagaaatttcaaaccaggagcccctcaagatatga

SEQ ID NO: 5936 - RNA, 1290 nt, synthetic construct
  misc_feature 1..1290: note = derived and/or modified CDS sequence (opt3) from TULV(MG23/Omsk)__AF442621.1__N
  source 1..1290: mol_type = other RNA
atgagcaccctgaaggagatccaggaagagattacaagacacgaacaacagatagtgatcgccaggcagaaactcaaggacgctgagaaaactgtcgaagcagatcccgacgatgttaacaagaatacgcttcagtcccggcgcgccgcggtgtctaccctggaggacaaattggctgagttcaagcgacaattagccgatctggtatcaagtcagaagatgggcgaaaaacctgtggacccaacagggctagagccggatgaccatctcaaggaacgtagctccctgagatacggaaacgtccttgatgtgaatgcaactgacattgatgagccctctggtcagaccgccgactggttttcgatcggccagtatattatggggttcgctctggcaatcgttttgaaagccctctacatgctgtcaacaaggggacggcaaaccataaaggagaacaaaggcactcgcatcaagtttaaggatgacagcagtattgaagagatcaatggtattagaaggcctaaacacctgtatgtgtccatgccaacagctcagtctaccatgaaggccgacgaactcacgcccgggcggttccgcactatcgtctgcggattatttcctgcgcagataatgcatcgaaacattatcagcccagtgatgggcgtaattggcttctcctttttcgttaaagattggcccgacaagatcgaggaatttctgatcaaaccttgtccattccttaagaaacaggggtcaaccaaggaggaggaatttttggtgagtaatgatgcatacatgctgggaagagagaaggccctaagggaaagccacctcgctgagattgacgaactgatagatcttgccgactctggtgatccgacaccccctgactccatcaaatcaccacaagcaccctgggtcttcgcttgcgcccctgatcggtgtccacccacttgcatttatatcgcgggcatggccgagctgggggcatttttcagcatattgcaggacatgcgtaacaccattatggctagtaagacagtgggaaccgccgaggaaaaactcaagaaaaagtcttccttctaccagagctatctgcgcagaacgcaatcgatgggcatccagttagatcagaggatcattctgctctttatgatggagtggggttctgacatcgtgaatcatttccaccttggggacgatatggacccggaactgcggactttggctcagtccctaattgatcaaaaggtcaaagagatatcaaaccaggaacctctgaagatctga

SEQ ID NO: 5937 - RNA, 1290 nt, synthetic construct
  misc_feature 1..1290: note = derived and/or modified CDS sequence (opt3) from TULV(c109-s)__AF164094.1__N
  source 1..1290: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcgcgccgcggtgtcagctctggaggacaaattggccgatttcaagcgacagttagcagacctggtaagtagccagaagatgggcgagaaacctgtggatccaacggggctagaaccggacgatcatctcaaggagcgttcctctctgagatacggaaatgtccttgacgtgaacgccattgatatcgacgaaccctcgggtcagaccgctgattggttttcaattggccaatatatcacagggttcgcactggccataatcttgaaagctctctacatgctgagcactaggggacggcagaccattaaggagaataaaggcacacgcatcagatttaaggacgacagttcctatgaggaaattaacggtatcaggcggcctaagcacctgtacgtttctatgccaaccgcccagagcactatgaaagcggatgagctcacacccgggcgcttccgaaccatagtgtgcggattatttcctgcacagattatgcatagaaatatcatttccccagtcatgggcgtgatcggcttctcatttttcgtaaaggactggcccgagaaaatcgaagaatttctgattaagccttgtccattccttaaaaagagtgggccgagcaaagaggaggactttttggtttctaacgatgcctatctgctaggaagggaaaaggctctccgggagtcccacctggccgaaatagatgaccttatcgatctggcagcttcaggtgaccccacgcctccagatagcattaagagtccccaagccccttgggtgttcgcgtgcgccccagaccgttgtcccccgacttgcatctacatagcaggcatggctgagttgggggcctttttctctattctccaggatatgcgcaataccatcatggcttccaaaacagtcggaactagcgaagagaagctgaaaaagaaatcgtctttctatcagtcctacttaagaaggacccaatcaatgggcatccagctggaccagcggattatcctcctttttatgacagagtggggtagtgacattgtgaaccatttccacctgggggatgacatggatcctgaattgcgaaccctagcccagagcctgatagaccaaaaggtgaaggagatctccaatcaggaacccctcaaaatttga

SEQ ID NO: 5938 - RNA, 1290 nt, synthetic construct
  misc_feature 1..1290: note = derived and/or modified CDS sequence (opt3) from TULV(CHEVRU/Hu/FRA/2015/15.00453)__KT946591.1__N
  source 1..1290: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcaggccgcggtgtcagctctggaggacaaattggccgatttcaagcgcaagttagcagacctggtaagtagccagaaaatgggcgagaagcctgtggatccaacggggctagaaccggacgatcatctcaaagagcgatcctctctgcgttacggaaatgtccttgacgtgaacgccattgatatcgacgaaccctcgggtcagaccgctgattggttttcaattggccaatatgttatggggttcgcactggccatcatattgaaggctctctacatgctgagcacaagaggaaggcagactatcaaagagaataagggcacccggattcgctttaaggacgacagttcctatgaggaaatcaacggtattagaaggcctaaacacctgtacgtgtctatgccaacagcccagagcaccatgaaggcggatgagctcactcccgggcggttccgcacaatcgtctgcggattatttcctgcacagataatgcatcgaaatattatctccccagtgatgggcgtaattggcttctcatttttcgttaaagactggcccgaaaagatcgaggaatttctgatcaaaccttgtccattccttaagaaaagtgggccgagcaaggaggaggactttttggtgtctaacgatgcctatctgctaggaagagaaaaggctctcagggattcccacctggccgagattgacgatcttatagacctggcagaatcaggtgatcccacccctccagacagcatcaaaagtccccaagctccttgggtcttcgcctgcgcgccagatcggtgtcccccgacgtgcatttacatcgccggcatggcagagttgggggcctttttctctatactccaggacatgcgtaatactattatggcttccaagaccgtgggaacagctgaagagaaactgaagaaaaagagctcgttctatcagtcttacttacgcagaactcaatccatgggcatccagctggaccagaggatcattctcctttttatgatcgagtggggttcagatattgtgaaccatttccacctgggggacgatatggaccctgaattgcggaccctagcccagagtctgatagatcaaaaggtcaaagagatcagcaatcaggaacccctcaagatttga

SEQ ID NO: 5939 - RNA, 1290 nt, synthetic construct
  misc_feature 1..1290: note = derived and/or modified CDS sequence (opt3) from TULV(g20-s)__AF164093.1__N
  source 1..1290: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcaggccgcggtgtcagctctggaggacaaattggccgatttcaagcgcaagttagcagacctggtaagtagccagaaaatgggcgagaagcctgtggatccaacggggctagaaccggacgatcatctcaaagagcgatcctctctgcgttacggaaatgtccttgacgtgaacgccattgatatcgacgaaccctcgggtcagaccgctgattggttttcaattggccaatatgttatggggttcgcactggccatcatattgaaggctctctacatgctgagcacaagaggaaggcagactatcaaagagaataagggcacccggattcgctttaaggacgacagttcctatgaggaaatcaacggtattagaaggcctaaacacctgtacgtgtctatgccaacagcccagagcaccatgaaggcggatgagctcactcccgggcggttccgcacaatcgtctgcggattatttcctgcacagataatgcatcgaaatattatctccccagtgatgggcgtaattggcttctcatttttcgttaaagactggcccgaaaagatcgaggaatttctgatcaaaccttgtccattccttaagaaaagtgggccgagcaaggaggaggactttttggtgtctaacgatgcctatctgctaggaagagaaaaggctctcagggattcccacctggccgagattgacgatcttatagacctggcagaatcaggtgatcccacccctccagacagcatcaaaagtccccaagctccttgggtcttcgcctgcgcgccagatcggtgtcccccgacgtgcatttacatcgccggcatggcagagttgggggcctttttctctatactccaggacatgcgtaatactattatggcttccaagaccgtgggaacagctgaagagaaactgaagaaaaagagctcgttctatcagtcttacttacgcagaactcaatccatgggcatccagctggaccagaggatcattctcctttttatgaccgagtggggttcagatatcgtgaaccatttccacctgggggacgatatggaccctgaattgcggacactagcccagagtctgattgatcaaaaggtcaaagagataagcaatcaggaacccctcaagatctga

SEQ ID NO: 5940 - RNA, 1293 nt, synthetic construct
  misc_feature 1..1293: note = derived and/or modified CDS sequence (opt3) from TULV(Sennickerode Sen05/174)__EU439948.1__N
  source 1..1293: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcgcgccgcggtgtcagctctggaggacaaattggccgatttcaagcgacagttagcagacctggtaagtagccagaagatgggcgagaaacctgtggatccaacggggctagaaccggacgatcatctcaaggagcgttcctctctgagatacggaaatgtccttgacgtgaacgccattgatatcgacgaaccctcgggtcagaccgctgattggttttcaattggccaatatatcatagggttcgcactggccatcgttttgaaagctctctacatgctgagcacaaggggacggcagactattaaggagaataaaggcacccgcatcagatttaaggacgacagttccttcgaggaaattaacggtatcaggcggcctaagcacctgtatgtgtctatgccaacagcccagagcaccatgaaagcggatgagctcactcccgggcgctttcgaacaatagtctgcggattattccctgcacagattatgcatagaaatatcatttccccagtgatgggcgtaatcggcttttcattctttgttaaggactggcccgataaaatcgaagagttcctgattaagccttgtccatttcttaaaaagcaagggggaccgaacaaagacgaagatttcttggtgagtaatgacgcctactttctgggtagggagaaggctctacgggagagccacctcaacgaaatagatgacctgatcgagcttgccgcatctggcgatcccacccctccagactccattaagtcaccccaggctccttgggtcttcgcctgcgcgccagatcgttgtcccccgacgtgcatctatgtggccgggatggcagaactgggagctttctttagcatattgcaggacatgcgcaatactattatggccagtaaaaccgtgggcacagctgaggaaaagctcaaaaagaaatcttccttctaccaaagctatctgagaaggactcagtcgatgggtatccagttagaccagcggatcattctgctctttatgatggagtgggggtctgatatcgtcaaccatttccaccttggagacgatatggaccctgagctgcgaaccttggcccaatccctaattgatcagaaggttaaggaaatatcaaatcaggagcccctgaaaatctga

SEQ ID NO: 5941 - RNA, 1293 nt, synthetic construct
  misc_feature 1..1293: note = derived and/or modified CDS sequence (opt3) from TULV(Sennickerode Sen05/175)__EU439949.1__N
  source 1..1293: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcgcgccgcggtgtcagctctggaggacaaattggccgatttcaagcgacagttagcagacctggtaagtagccagaagatgggcgagaaacctgtggatccaacggggctagaaccggacgatcatctcaaggagcgttcctctctgagatacggaaatgtccttgacgtgaacgccattgatatcgacgaaccctcgggtcagaccgctgattggttttcaattggccaatatatcatagggttcgcactggccatcgttttgaaagctctctacatgctgagcacaaggggacggcagactattaaggagaataaaggcacccgcatcagatttaaggacgacagttccttcgaggaaattaacggtatcaggcggcctaagcacctgtatgtgtctatgccaacagcccagagcaccatgaaagcggatgagctcactcccgggcgctttcgaacaatagtctgcggattattccctgcacagattatgcatagaaatatcatttccccagtgatgggcgtaatcggcttttcattctttgttaaggactggcccgataaaatcgaagagttcctgattaagccttgtccatttcttaaaaagcaagggggaccgaacaaagacgaagatttcttggtgagtaatgacgcctactttctgggtagggagaaggctctacgggagagccacctcaacgaaatagatgacctgatcgagcttgccgcatctggcgatcccacccctccagactccattaagtcaccccaggctccttgggtcttcgcctgcgcgccagatcgttgtcccccgacgtgcatctatgtggccgggatggcagaactgggagctttctttagcatattgcaggacatgcgcaaaagtattatggcctctaagactgtgggcaccgctgaggaaaaactcaagaaaaagtccagcttctaccaatcgtatctgagaaggacacagtctatgggtatccagttagaccagcggatcattctgctctttatgatggagtgggggtccgatatcgtcaatcatttccaccttggagacgatatggaccctgagctgcgaactttggcccaatcactaattgatcagaaggttaaagaaataagtaaccaggagcccctgaagatctga

SEQ ID NO: 5942 - RNA, 1293 nt, synthetic construct
  misc_feature 1..1293: note = derived and/or modified CDS sequence (opt3) from TULV(TUL/Karatal/Ma322/2003)__AM945877.1__N
  source 1..1293: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagaatactcttcaatcccggcgcgccgcggtgtctgctctggaggacaaattggccgagttcaagcgacagttagcagatctggtatcaagtcagaagatgggcgaaaaacctgtggacccaacggggctagagccggatgaccatctcaaggaacgtagctccctgagatacggaaacgtccttgatgtgaatgccattgacatcgatgagccctctggtcagaccgctgactggttttcgattggccaatatgttatggggttcgcactggccatcgtgttgaaagctctctacatgctgtcaacaaggggacggcagactataaaggagaacaaaggcacccgcatcagatttaaggatgacagcagtttcgaagagattaatggtatcaggcggcctaagcacctgtatgtctccatgccaacagcccagtctaccatgaaagcggacgaactcactcccgggcgctttcgaacaattgtgtgcggattattccctgcacagatcatgcatagaaacataattagcccagtaatgggcgttatcggcttttccttctttgtgaaggattggcccgagaaaattgaagagttcctgatcaagccttgtccatttcttaaaaagcaagggtcaagtggaaaagaggaagagttcttggtcagcaatgacgcctacctgatcggtagggaaaagaccctacaggagtctcacctcacggaaattgatgacctgatagatcttgctgactccggcgatccgactccccctgactcaatcaagagcccacaggccccctgggtgtttgcatgcgctcctgatcggtgtccaccgacctgcatttatatcgccgggatggcggagctgggagccttcttcagtatattgcaagacatgcgtaacacaattatggcatctaaaactgtgggcaccgctgaggaaaagctcaaaaagaaatccagcttttaccagtcgtatctgcgcagaacacagtctatgggtatccagttagatcaaaggatcattctcctgttcatgatggagtgggggtccgacatcgtcaatcattttcaccttggagacgatatggaccccgaactgcggaccttggcccagtcactaattgatcagaaggttaaggagataagtaaccaggaacctctgaaaatctga

SEQ ID NO: 5943 - RNA, 1293 nt, synthetic construct
  misc_feature 1..1293: note = derived and/or modified CDS sequence (opt3) from TULV(Tula/Kosice144/Ma/95)__Y13979.1__N
  source 1..1293: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcgcgccgcggtgtcagctctggaggacaaattggccgatttcaagcgacagttagcagacctggtaagtagccagaagatgggcgagaaacctgtggatccaacggggctagaaccggacgatcatctcaaggagcgttcctctctgagatacggaaatgtccttgacgtgaacgccattgatatcgacgaaccctcgggtcagaccgctgattggttttcaattggccaatatatcatagggttcgcactggccatcgttttgaaagctctctacatgctgagcacaaggggacggcagactattaaggagaataaaggcacccgcatcagatttaaggacgacagttccttcgaggaaattaacggtatcaggcggcctaagcacctgtatgtgtctatgccaacagcccagagcaccatgaaagcggatgagctcactcccgggcgctttcgaacaatagtctgcggattattccctgcacagattatgcatagaaatatcatttccccagtgatgggcgtaatcggcttttcattctttgttaaggactggcccgagaaaatcgaagagttcctgattaagccttgtccatttcttaaaaagcaaggggccccgggaaaagaagaggatttcttggtgagtaacgacgcttacctgctaggtagggaaaaggccctccgggagagccacctggcagaaatagatgaccttatcgatctggctgcctctggcgaccccacccctccagattccattaagtcaccccaggcgccttgggtctttgcctgcgcaccagaccgttgtcccccgacgtgcatctatatagctgggatggccgagttgggagctttcttcagcattctccaggatatgcgcaatactatcatggccagtaaaaccgtgggcacagcagaagagaagctgaaaaagaaatcttccttttaccaaagctatttaagaaggactcagtcgatgggtatccagctggaccagcggattatcctccttttcatgaccgagtgggggtctgacattgtgaaccattttcacctgggagatgacatggatcctgaattgcgaacactagcccaatccctgatagaccagaaggtcaaggagatctcaaatcaggaacccctcaaaatttga

SEQ ID NO: 5944 - RNA, 1293 nt, synthetic construct
  misc_feature 1..1293: note = derived and/or modified CDS sequence (opt3) from TULV(Tula/Kosice667/Ma/95)__Y13980.1__N
  source 1..1293: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcgcgccgcggtgtcagctctggaggacaaattggccgatttcaagcgacagttagcagacctggtaagtagccagaagatgggcgagaaacctgtggatccaacggggctagaaccggacgatcatctcaaggagcgttcctctctgagatacggaaatgtccttgacgtgaacgccattgatatcgacgaaccctcgggtcagaccgctgattggttttcaattggccaatatatcatagggttcgcactggccatcgttttgaaagctctctacatgctgagcacaaggggacggcagactattaaggagaataaaggcacccgcatcagatttaaggacgacagttccttcgaggaaattaacggtatcaggcggcctaagcacctgtatgtgtctatgccaacagcccagagcaccatgaaagcggatgagctcactcccgggcgctttcgaacaatagtctgcggattattccctgcacagattatgcatagaaatatcatttccccagtgatgggcgtaatcggcttttcattctttgttaaggactggcccgagaaaatcgaagagttcctgattaagccttgtccatttcttaaaaagcaaggggccccgggaaaagaagaggatttcttggtgagtaacgacgcttacctgctaggtagggaaaaggccctccgggagagccacctggcagaaatagatgaccttatcgatctggctgcctctggcgaccccacccctccagattccattaagtcaccccaggcgccttgggtctttgcctgcgcaccagaccgttgtcccccgacgtgcatctatatagctgggatggccgagttgggagctttcttcagcattctccaggatatgcgcgacactatcatggccagtaaaaccgtgggcacagcagaagagaagctgaaaaagaaatcttccttttaccaaagctatttaagaaggactcagtcgatgggtatccagctggaccagcggattatcctccttttcatgaccgagtgggggtctgatattgtgaatcattttcacctgggagacgatatggaccctgaattgcgaacactagcccaatccctgatagatcagaaggtcaaggagatctcaaaccaggaacccctcaaaatttga

SEQ ID NO: 5945 - RNA, 1290 nt, synthetic construct
  misc_feature 1..1290: note = derived and/or modified CDS sequence (opt3) from TULV(Tula/Koziky/5247Ma/94)__AJ223600.1__N
  source 1..1290: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcgcgccgcggtgtcagctctggaggacaaattggccgatttcaagcgacagttagcagacctggtaagtagccagaagatgggcgagaaacctgtggatccaacggggctagaaccggacgatcatctcaaggagcgttcctctctgagatacggaaatgtccttgacgtgaacgccattgatatcgacgaaccctcgggtcagaccgctgattggttttcaattggccaatatatcacagggttcgcactggccataatcttgaaagctctctacatgctgagcactaggggacggcagaccattaaggagaataaaggcacacgcatcagatttaaggacgacagttcctatgaggaaattaacggtatcaggcggcctaagcacctgtacgtttctatgccaaccgcccagagcactatgaaagcggatgagctcacacccgggcgcttccgaaccatagtgtgcggattatttcctgcacagattatgcatagaaatatcatttccccagtcatgggcgtgatcggcttctcatttttcgtaaaggactggcccgagaaaatcgaagaatttctgattaagccttgtccattccttaaaaagaacgggccgagtaaagaggaggactttttggttagcaatgatgcctatctgctaggaagggaaaaggctctccgggagtctcacctggccgaaatagatgaccttatcgatctggcagcttccgaggaccccacgcctccagattcaattaagagcccccaagccccttgggtgttcgcgtgccgtccagaccgctgtcccccgacttgcatctacatagccggtatggcagaattgggcgcctttttcagtattctccaggatatgagaaacaccatcatggcttctaaaacagtcgggactgctgaggagaagctgaaaaagaaatccagcttctatcagtcgtacttaaggcggacccaatctatgggaatccagctggaccagcgaattatcctcctttttatgacagaatggggctccgacattgtgaatcatttccacctgggtgatgacatgtcacctgagttgcgcaccctagcccagagtctgatagatcaaaaggtgaaggaaatcagcaaccaggagcccctcaaaatttga

SEQ ID NO: 5946 - RNA, 1290 nt, synthetic construct
  misc_feature 1..1290: note = derived and/or modified CDS sequence (opt3) from TULV(Tula/Moravia/5302v/95)__Z69991.1__N
  source 1..1290: mol_type = other RNA
atgagccagctgaaggagatccaagaagagattaccagacacgaacagcagatagtgatcgccaggcagaaactcaaggacgtcgagaaaacagttgaagctgatcccgacgatgtgaacaagtccactcttcaatctcggcgcgcagccgtatcagcgctggaggacaaattggctgatttcaagcgacagttagccgacctggtgagtagccagaagatgggcgagaaacctgtcgatccaacggggctagaaccggacgatcatctcaaggagcgttcctctctgagatacggaaatgtgcttgacgttaacgcaattgatatcgacgaaccctcgggtcagaccgccgattggttttcaattggccaatatatcacagggttcgctctggcaataatcttgaaagccctctacatgctgagcactaggggacggcagaccattaaggagaataaaggcacacgcatcagatttaaggacgacagttcctatgaggaaattaacggtatcaggcggcctaagcacctgtacgtgtctatgccaaccgctcagagcactatgaaagccgatgagctcacacccgggcgcttccgaaccatagtctgcggattatttcctgcgcagattatgtatagaaatatcatttccccagtgatgggcgtaatcggcttctcatttttcgttaaggactggcccgagaaaatcgaagaatttctgattaagccttgtccattccttaaaaagagtgggccgagcaaagaggaggactttttggtgtctaacgatgcatacctgctaggaagggaaaaggccctccgggagtcccatctggctgaaatagatgaccttatcgatctggccgcatcaggtgaccccacgcctccagatagcattaagagtccccaagctccttgggtcttcgcctgccgtccagaccgctgtcccccgacttgcatctatatagcgggcatggccgagttgggggcatttttctctattctccaggatatgagaaataccatcatggcttccaaaacagtgggaactgccgaagagaagctgaaaaagaaaagctcgttctaccagtcttacttaaggcggacccaatccatgggcatccagctggaccagcgaattatcctcctttttatgacagagtggggttcagacattgtgaaccacttccatctgggggatgacatggatcctgaattgcgcaccctagctcagagtctgatagaccaaaaggtcaaggagatcagcaatcaggaacccctcaaaatttga

SEQ ID NO: 5947 - RNA, 1293 nt, synthetic construct
  misc_feature 1..1293: note = derived and/or modified CDS sequence (opt3) from TULV__AF017659.1__N
  source 1..1293: mol_type = other RNA
atgagccagctgaaggagatccaagaagagattaccagacacgaacagcagatagtgatcgccaggcagaaactcaaggacgctgagaaaacagtcgaagcagatcccgacgatgttaacaagtccactcttcaatctcggcgcgccgcggtgtcagctctggaggacaaattggccgatttcaagcgacagttagcagacctggtaagtagccagaagatgggcgagaaacctgtggatccaacggggctagaaccggacgatcatctcaaggagcgttcctctctgagatacggaaatgtccttgacgtgaacgccattgatatcgacgaaccctcgggtcagaccgctgattggttttcaattggccaatatatcatagggttcgcactggccatcgttttgaaagctctctacatgctgagcacaaggggacggcagactattaaggagaataaaggcacccgcatcagatttaaggacgacagttccttcgaggaaattaacggtatcaggcggcctaagcacctgtatgtgtctatgccaacagcccagagcaccatgaaagcggatgagctcactcccgggcgctttcgaacaatagtctgcggattattccctgcacagattatgcatagaaatatcatttccccagtgatgggcgtaatcggcttttcattctttgttaaggactggcccgagaaaatcgaagagttcctgattaagccttgtccatttcttaaaaagcaaggggccccgggaaaagaagaggatttcttggtgagtaacgacgcttacctgctaggtagggaaaaggccctccgggagagccacctggcagaaatagatgaccttatcgatctggctgcctctggcgaccccacccctccagattccattaagtcaccccaggcgccttgggtctttgcctgcgcaccagaccgttgtcccccgacgtgcatctatgtggctgggatggccgagttgggagctttcttcagcatactccaggatatgcgcaatactattatggccagtaaaaccgtgggcacagcagaagagaagctgaaaaagaaatcttccttttaccaaagctatttaagaaggactcagtcgatgggtatccagctggaccagcggatcattctccttttcatgaccgagtgggggtctgacatcgtcaaccattttcacctgggagatgacatggatcctgaattgcgaacactagcccaatccctgattgaccagaaggttaaggagatatcaaatcaggaacccctcaaaatctga

SEQ ID NO: 5948 - RNA, 1293 nt, synthetic construct
  misc_feature 1..1293: note = derived and/or modified CDS sequence (opt3) from TULV(Lodz-1)__AF063892.1__N
  source 1..1293: mol_type = other RNA
atgaccgagctgaaggaaatccaggaggaaattacaagacacgagcaacagatagtgatcgccaggcagaaactcaaggacgctgagaaaactgtcgaagcagatcccgacgatgttaacaagagcacgcttcagtcccggcgcgccgcggtgtctgctctggaggacaaattggccgatttcaagcgacaattagcagacctggtatcaagtcagaagatgggcgaaaaacctgtggatccaaccgggctagagccggacgatcatctcaaggaacgtagctccctgagatacggaaatgtccttgacgtgaacgccattgatatcgacgagccctctggtcagacagctgattggttttcgattggccagtatatcatggggttcgcactggccatagttttgaaagctctctacatgctgtcaactaggggacggcaaaccatcaaggagaataaaggcacacgcattagatttaaggacgacagcagttatgaagagatcaacggtattaggcggcctaagcacctgtacgtgtccatgccaaccgcccagtctactatgaaagcggatgaactcacacccgggcgcttccgaaccatcgtctgcggattatttcctgcacagataatgcatagaaatattatcagcccagtgatgggcgtaattggcttctcctttttcgttaaggactggcccgataaaatcgaggaatttctgatcaagccttgtccattccttaaaaagcaagggggaccgaacaaagacgaggagtttttggtgtcaaatgatgcctatctgctaggtagggaaaaggctctccgggagagtcacctggccgaaattgacgatcttatagacctggcagctagcggcgatcccacgcctccagactctatcaagtcaccccaggccccttgggtcttcgcgtgcgccccagatcgttgtcccccgacttgcatttacgtggcagggatggctgagttgggagcctttttctccatcctccaggacatgcgcaacaccataatggctagcaaaacagtgggcactgccgaagagaagctgaaaaagaaaagttctttctatcagtcctacttaagaaggacccaaagcatgggtattcagctggaccagcggatcatcctcctttttatgatggagtgggggtcggatattgtcaatcatttccacctgggagacgatatggaccctgaattgcgaacactagcacagtctctgatcgatcaaaaggttaaggagatttccaaccaggaacccctcaaaatatga

SEQ ID NO: 5949 - RNA, 1293 nt, synthetic construct
  misc_feature 1..1293: note = derived and/or modified CDS sequence (opt3) from TULV(Lodz-2)__AF063897.1__N
  source 1..1293: mol_type = other RNA
atgaccgagctgaaggaaatccaggaggaaattacaagacacgagcaacagatagtgatcgccaggcagaaactcaaggacgctgagaaaactgtcgaagcagatcccgacgatgttaacaagagcacgcttcagtcccggtgggccgcggtgtctgctctggaggacaaattggccgatttcaagcgccaattagcagacctggtatcaagtcagaagatgggcgaaaaacctgtggatccaaccgggctagagccggacgatcatctcaaggaacgaagctccctgcgttacggaaatgtccttgacgtgaacgccattgatatcgacgagccctctggtcagacagctgattggttttcgattggccagtatatcatggggttcgcactggccatagttttgaaagctctctacatgctgtcaactagaggaaggcaaaccatcaaggagaataaaggcacacggattcgctttaaggacgacagcagttatgaagagatcaacggtattagaaggcctaagcacctgtacgtgtccatgccaaccgcccagtctactatgaaagcggatgaactcacacccgggcggttccgcaccatcgtctgcggattatttcctgcacagataatgcatcgaaatattatcagcccagtgatgggcgtaattggcttctcctttttcgttaaggactggcccgataaaatcgaggaatttctgatcaagccttgtccattccttaaaaagcaagggggaccgaacaaagacgaggagtttttggtgtcaaatgatgcctatctgctaggtagagaaaaggctctcagggagagtcacctggccgaaattgacgatcttatagacctggcagctagcggcgatcccacgcctccagactctatcaagtcaccccaggccccttgggtcttcgcgtgcgccccagatcggtgtcccccgacttgcatttacgtggcagggatggctgagttgggagcctttttctccatcctccaggacatgcgtaacaccataatggctagcaaaacagtgggcactgccgaagagaagctgaaaaagaaaagttctttctatcagtcctacttacgcagaacccaaagcatgggtattcagctggaccagaggatcatcctcctttttatgatggagtgggggtcggatattgtcaatcatttccacctgggagacgatatggaccctgaattgcggacactagcacagtctctgatcgatcaaaaggttaaggagatttccaaccaggaacccctcaaaatatga

SEQ ID NO: 5950 - RNA, 1449 nt, synthetic construct
  misc_feature 1..1449: note = derived and/or modified CDS sequence (opt3) from CCHFV(IbAr10200)__NC_005302.1/U88410.1__N
  source 1..1449: mol_type = other RNA
atggagaacaagatcgaagtgaataacaaagacgagatgaatagatggttcgaagagtttaagaaaggcaacgggctggtcgataccttcacaaatagctactccttttgcgaatctgttcccaacctcgacaggttcgtgtttcagatggcctcagctactgatgacgcacaaaaggatagtatttatgccagcgcgcttgtagaggctacgaaattctgtgcccctatatacgagtgcgcatgggtgtcctctaccggaatcgtcaagaagggtctggaatggtttgagaaaaatgccggcacaattaagtcgtgggacgaatcatatactgagttgaaagtggatgttccaaagatcgagcagttaaccgggtaccagcaggctgcactgaaatggcggaaggacattggattccgcgtgaacgccaatacagctgccctaagcaacaaggtcctcgcggaatataaagtgccgggcgagatcgtaatgagtgttaaggaaatgctgtccgatatgatacgacgtagaaatcttatcctgaacaggggtggggacgagaatccccggggacctgtgtctcacgaacatgtcgattggtgtcgcgagtttgtgaaaggcaagtacattatggcattcaacccaccctggggcgacatcaataaaagcgggagatccggaattgccttggtggctaccggtctcgccaagctggcagagactgaaggcaaagggatctttgatgaggctaagaagacagtcgaagccctgaacggatatctcgacaaacacaaggacgaggttgatagggcgtcagccgacagtatgataaccaacttactgaaacatattgcaaaggctcaagaactttacaaaaatagctctgccttgcgggctcagtccgcccagatcgatacggcattctcaagctactattggctgtacaaggccggcgtgactcctgagacctttccaacagtaagtcagttcctattcgagctcggtaagcaaccccgcgggactaaaaagatgaaaaaggctctgctttctacccctatgaaatggggaaagaagctgtatgaattgtttgcggacgattccttccagcagaaccgaatttacatgcacccagcagtgctcacagccggcagaatcagcgagatgggcgtctgctttgggaccatcccggtggctaatcccgacgatgccgcacagggatcgggtcatacgaaatctattctgaacttaaggactaatacagaaaccaacaatccttgtgccaagactatagttaaactgttcgaggtgcaaaagacaggctttaacatccaggacatggatattgtcgcttccgaacacctccttcaccagtcactggtggggaaacaaagtccattccagaatgcctataacgtaaagggaaatgcaaccagcgcgaacatcatatga

SEQ ID NO: 5951 - RNA, 1449 nt, synthetic construct
  misc_feature 1..1449: note = derived and/or modified CDS sequence (opt3) from CCHFV(Turkey-Kelkit06)__GQ337053.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaagactcgggcacaattaagtcatgggatgaaaattatgccgagttgaaagtcgacgtgccaaagatcgagcagttagctaactaccagcaggcagccctgaagtggagaaaagatattgggttcagggttaatgctaacactgccgcgctaagcaataaggtgctcgcagaatataaagtcccgggagagatcgtgatgagtgtaaaggaaatgctgtccgacatgatacggcgccgaaaccttatcctgaatcgtggcggtgatgagaaccccagagggcctgtttctagggaacacgtggagtggtgtcgggagtttgtcaaaggaaagtacattatggccttcaatccaccctggggcgacatcaacaaaagcggccgctccgggattgctttggtggccaccggactcgcaaagctggctgaaacagagggtaagggcgtgtttgatgaagccaaaaagaccgtcgaggcgctgaacgggtatctcgacaaacatagagacgaagttgataaggcctcagcagacagtatgatcactaatttacctaaacacatagctaaggcccaagagctgtacaagaacagctctgctcttagggcccagggagcacagattgatacaccattctcctcattttactggttgtataaagccggcgtgacccccgagacgttccctactatcagccagttcctgtttgaactaggtgagcaaccacgggggaccaagaaaatgaagaaagctctcctgagtacaccgatgaagtggggaaagaaactttacgaactgttcgcggacgattcttttcagcagaatcgcatttatatgcatcccgcagtattgactgccggccgaatctccgagatgggcgtgtgcttcgggaccatccctgtcgctaacccagacgatgccgcacagggaagcggtcacacaaagtcgattctcaatctgagaacctctacggaaactaacaatccctgtgccaaaacaatagtgaagttatttgagatccaagagaccggcttcaacattcaggacatggatatcgttgcttccgaacatctgctccaccagtcaatagtggggaaacaaagtccttttcagaatgcctacaacgtcaagggaaatgcaactagcgcgaacattatctga

SEQ ID NO: 5952 - RNA, 1449 nt, synthetic construct
  misc_feature 1..1449: note = derived and/or modified CDS sequence (opt3) from CCHFV(Baghdad 12)__AJ538196.1__N
  source 1..1449: mol_type = other RNA
atggagaacaagatcgaagtgaatagcaaagacgagatgaacaagtggttcgaagagtttaaaaagggcaatgggctggtcgatacctacacaaactcctattctttctgcgaatcagttcccaatctcgacagatttgtgttccagatggccggagctactgatgacgcacaaaaagatagtatttacgccagcgcgcttgtagaggctacgaagttttgtgcccctatatatgagtgcgcatgggcctcctctaccggtatcgtgaagaaaggcctggaatggttcgagaagaacacagggactattaaatcgtgggacgaatcatacaccgagttgaaggtcgaggtgccaaaaatcgaacagttatttaattatcagcaggctgcactgaagtggaggaaggatattggattccgggttaacgccaatacagctgccctaagcaacaaagtgctcgcggagtacaaggtcccgggcgaaatcgtgatgagtgtaaaagagatgctgtccgacatgatacgccgacgtaatcttatcctgaacagaggtggggatgaaaatcccaggggacctgtttctcgggagcacgtggagtggtgtcgcgaatttgtcaagggcaaatatattatggcattcaacccaccctggggcgacatcaataagagcgggagatccggaattgccttggtggctaccggtctcgccaaactggcagagactgaaggcaagggggtgtttgatgaggctaagaaaacagtcgaagccctgaacggatacctcgacaagcataaagatgaggttgacaaggcgtcagccgacaacatggtgaccaatttactgaaacacgtagcaaaggctcaagagctttacaagaacagtagcgccttgagggctcagggcgcccagatcgatacggtgttctcttcctattactggctgtataaagccggtgtcactcctgaaacctttccaacagtgtcacagttcctattcgagctcgggaagcatccccggggaactaaaaagatgaaaaaggcactgcttagcacccctatgaagtggggcaaaaagctgtacgaattgtttgctgacgatagtttccaacagaatcgcatatatatgcacccagcggttctcacagcaggccgaatttctgagatgggggtgtgctttggaaccatcccggtcgccaaccccgacgatgctgccctgggttccggccatacgaaaagcattttaaatctgagaactaacacagaaaccaataacccttgtgcaaggactatcgtgaaactcttcgagatccagaagacagggtttaatattcagcacatggacatagtagcctcggagcaccttctgcatcaatctttggttggaaagcagtccccattccagaacgcttacaatgtgaagggcaacgccacctcagcaaatatcatttga

SEQ ID NO: 5953 - RNA, 1449 nt, synthetic construct
  misc_feature 1..1449: note = derived and/or modified CDS sequence (opt3) from CCHFV(SR3)__AJ538198.1__N
  source 1..1449: mol_type = other RNA
atggagaacaagatcgaagtgaatagcaaagacgagatgaacaagtggttcgaagagtttaaaaagggcaatgggctggtcgataccttcacaaactcctactctttttgcgaatcagttcccaatctcgacagattcgtgtttcagatggccagtgctactgatgacgcacaaaaagatagcatttatgcctccgcgcttgtagaggctacgaagttctgtgcccctatatacgagtgcgcatgggcctcttcgaccggaatcgtgaagaaaggtctggaatggtttgagaagaacgctggcacaattaaatcatgggacgaaagctatactgagttgaaggtcgaggtgccaaaaatcgaacagttaagtaattaccagcaggcagccctgaagtggaggaaggatattgggttccgggttaacgctaataccgccgcgctatccaacaaagtgctcgcagagtataaggtcccgggagaaatcgtgatgtctgtaaaagagatgctgagcgacatgatacgccgacgtaatcttatcctgaacagaggcggtgatgaaaatcccagggggcctgtttcccgggagcacgtggagtggtgtcgcgaatttgtcaagggaaaatacattatggccttcaacccaccctggggcgacatcaataagtcaggcagaagtgggattgctttggtggccacaggactcgcaaaactggctgagaccgaaggtaagggcgtgtttgatgaggccaagaaaactgtcgaagcgctgaacgggtatctcgacaagcataaagatgaggttgacaaggccagcgcagactctatgatcacaaacttactgaaacacatagctaaggcccaagagctttacaaaaattcctcagctttgagggcccagggagcacagattgataccgtgttcagcagttactattggctgtacaaagccggcgtaacgcctgacacttttccagctgtgtctcagttcctattcgaactcggtaagcaaccccgggggaccaaaaagatgaaaaaggcgctgctttccacacctatgaagtggggaaagaagctgtatgagttgtttgcagatgacagcttccagcagaaccgcatctacatgcatccagccgtcctcactgctggccgaatttcggaaatgggcgtgtgctttgggaccatcccggttgccaatcccgatgacgcagccctgggatctggtcacacaaaatccatcttaaacctgagaaccaatacggagactaacaatccttgtgctaagacaattgtgaaactcttcgaaatacagaagaccggctttaacatccaagatatggacattgtcgcctcagagcatcttctgcaccagagtttggtggggaagcagagcccattccaaaatgcatataacgtaaaaggaaatgcgacttccgctaacatcatatga

SEQ ID NO: 5954 - RNA, 1449 nt, synthetic construct
  misc_feature 1..1449: note = derived and/or modified CDS sequence (opt3) from CCHFV(Gaib)__KX013446.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctaactaccagcaggcagccctgaagtggaggaaggatattgggttccgggtgaatgctaacaccgccgcgctaagccacaaagtcctcgcagagtataaggtgccgggagaaatcgtaatgagtgttaaagagatgctgtccgacatgatacgccgacgtaatcttatcctgaacagaggcggtgatgaaaatcccagggggcctgtgtctcgggagcatgtcgagtggtgtcgcgaatttgtgaagggaaaatacattatggccttcaacccaccctggggcgacatcaataagagcggcagatccgggattgctttggtggccacaggactcgcaaaactggctgagaccgaaggtaagggcgtctttgatgaggccaagaaaactgttgaagcgctgaacgggtatctcgacaagcacaaagatgaggtggacaaggcctcagcagacaacatgatcacaaatttactgaaacatatagctaaggcccaagagctttacaagaacagtagcgctttgagggcccagggagcacagattgataccgccttctcttcctactattggctgtacaaagctggcgtaacgcctgaaacttttccaaccgtgtcacagttcctattcgagctcggtaagcaaccccgggggactaaaaagatgaaaaaggcgctgcttagcacacctatgaagtggggcaaaaagctgtatgaattgtttgcagacgatagtttccagcagaatcgcatctacatgcacccagccgtcctcaccgctggacgaatttctgagatgggcgtgtgctttgggacaatcccggttgccaaccccgacgatgcagcccagggatccggtcataccaaaagcatcctgaatttaagaacgaacactgaaacaaataacccttgtgctaagaccattgtgaaactgttcgagatacaaaagactggctttaatatccaggacatggatattgtcgcctcggagcacctccttcaccagtctctggtggggaagcaatccccattccagaacgcatataatgtaaaaggaaacgcgacatcagctaatatcatatga

SEQ ID NO: 5955 - RNA, 1449 nt, synthetic construct
  misc_feature 1..1449: note = derived and/or modified CDS sequence (opt3) from CCHFV(Hodzha)__KX013449.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctaactaccagcaggcagccctgaagtggaggaaggatattgggttctgtgtgaatgctaacaccgccgcgctaagccaaaaagtcctcagtgagtataaggtgccgggagaaatcgtaatgtccgttaaagagatgctgtctgacatgatacggcgccgaaatcttatcctgaaccgtggcggtgatgaaaatcccagagggcctgtgagcagggagcacgtcgagtggtgccgggaatttgtgaagggaaaatacattatggcattcaacccaccctggggcgacatcaataagtccggccgctcagggattgccttggtggctacaggactcgccaaactggcagagaccgaaggtaagggcgtctttgatgaggctaagaaaactgttgaagccctgaacgggtatctcgacaagcataaagatgaggtggacaaggcgagtgccgacaacatgacaaccaatttactgaaacacatcgcaaaggctcaggagctttacaagaacagctctgccttgagagctcagggagcccagatagatacggcattctcctcatactattggctgtacaaagccggcgtaactcctgaaacctttccaacagtgagccaattcctattcgagctcggtaagcagcccagggggactaaaaagatgaaaaaggctctgcttagtacccctatgaagtggggcaaaaagctgtatgaattgtttgcggacgattctttccagcagaatcggatttacatgcatccagcagtcctcacaaccggacgcatctccgagatgggcgtgtgttttgggacggttccggtggccgaccccgatgacgctgcccaaggaagcggtcacactaaatcgattctgaacttacgaacaaataccgaaactaacaatccttgcgcaaagacaatcgtcaaactgttcgagatccagaagaccggctttaacattcaggatatggacatagtggcctctgagcatctccttcaccaatccctggtagggaagcagtcaccattccagaatgcttataacgttaaaggaaatgccacgagtgcaaacatcatttga

SEQ ID NO: 5956 - RNA, 1449 nt, synthetic construct
  misc_feature 1..1449: note = derived and/or modified CDS sequence (opt3) from CCHFV(IbAn7620)__KX013452.1__N
  source 1..1449: mol_type = other RNA
atggagaacaagatcgaagtgaataacaaagacgagatgaatagatggttcgaagagtttaagaaagaaaacggcctggtcgataccttcacaaatagccactccttttgcgagtctgttcccaacctcgacaagttcgtgtttcagatggcctcagctactgatgacgcacaaaaagatagtatttacgccgcggctcttgtagaggccacgaagttctgtgcacctatatatgaatgcgcctgggtgagctccaccgggatcgtcaagaaaggactggagtggtttgaaaagaatgctggtacaattaaatcttgggacgagtcgtacactgagttgaaggtggaagttccaaaaatcgagcagttatcaaactatcagcaggcagccctgaagtggaggaaggatattggcttccgggtgaatgctaacaccgccacactaagccataaagtcctcgcggaatacaaggtgccgggggagatcgtaatgagtgttaaagaaatgctgtccgacatgatacgccgacgtaatcttatcctgaacagaggaggcgatgagaatcccaggggtcctgtgtctcgggagcacgtcgaatggtgtcgcgagtttgtgaaggggaaatatattatggcattcaacccaccctggggagacatcaataagagcggcagatccggcattgccttggtggctaccgggctcgccaaactggcagaagctgagggaaagggtgtctttgatgaagccaagaaaactgttgaggcgctgaacggctacctcgacaagcataaagatgaggtggacaagtcaagtgccgacagcatgatcacaaacttactgaaacacatagcaaaggctcaagaactttataaaaattcttccgccttgagggctcagggggcccagattgataccgcattctcaagctactactggctgtataaagccggagtaacgcctgagacttttccaaccgtgagtcagttcctattcgaactcggcaagcaaccccggggtacaaagaagatgaaaaaggctctgctttctactcctatgaagtgggggaaaaagctgtacgagttgtttgcggacgattccttccagcagaaccgcatctatatgcatccagcagtcctcaccgccggacgaattagcgaaatgggcgtgtgctttggcacaatcccggttgctaatcccgacgatgccgcactggggtcgggacacaccaaatctatcttaaacctgagaacgtccactgaggccaataacccttgtgctaagacaattgtgaaactcttcgagatacagaagaagggttttgtcatcaaagacatggatattgtggcctcagaacaccttctgcatcaaagtttggtaggcaagcagagcccattccagaatgcatacaacgttaaagggaatgcgacctccgctaacatcatatga

SEQ ID NO: 5957 - RNA, 1449 nt, synthetic construct
  misc_feature 1..1449: note = derived and/or modified CDS sequence (opt3) from CCHFV(K128_76)__KX013455.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttccctcactcgacagattcgtgtttcagatggccagtgctactgatgacgcacaaaaagatagcatttatgcctccgcgcttgtagaggctacgaagttctgtgcccctatatacgagtgcgcatgggtgtcttcgaccggaatcgtcaagaaaggtctggaatggtttgagaagaacgccggcacaattaaatcatgggacgaaagctatactgagttgaaggtggaggttccaaaaatcgaacagttagctaattaccagcaggcagccctgaagtggaggaaggatattgggttccgggtgaacgctaataccgccgcgctaagtcacaaagtcctcgcagagtataaggtgccgggagaaatcgtaatgtccgttaaagagatgctgtctgacatgatacgccgacgtaaccttatcctgaatagaggcggtgatgaaaaccccagggggcctgtgagccgggagcatgtcgagtggtgtcgcgaatttgtgaagggaaaatacattatggccttcaatccaccctggggcgacatcaacaagtccggcagatcagggattgctttggtggccacaggactcgcaaaactggctgagaccgaaggtaagggcgtctttgatgaggccaagaaaactgttgaagcgctgaatgggtatctcgacaagcacaaagatgaggtggacaaggccagtgcagacaacatgatcacaaacttactgaaacatatagctaaggcccaagagctttacaagaatagctctgctttgagggcccagggagcacagattgataccgccttctcctcatactattggctgtacaaagctggcgtaacgcctgaaacttttccaaccgtgagccagttcctattcgagctcggtaagcaaccccgggggactaaaaagatgaaaaaggcgctgcttagtacacctatgaagtggggcaaaaagctgtatgaattgtttgcagacgattctttccagcagaaccgcatctacatgcacccagccgtcctcaccgctggacgaatttccgagatgggcgtgtgctttgggacaatcccggttgccaatcccgacgatgcagcccagggaagcggtcataccaaatcgatcctgaacttaagaacgaatactgaaacaaacaatccttgtgctaagaccattgtgaaactgttcgagatacaaaagactggctttaacatccaggacatggatattgtcgcctctgagcacctccttcaccagtccctggtggggaagcaatcaccattccagaatgcatataacgtaaaaggaaatgcgacaagtgctaacatcatatga

SEQ ID NO: 5958 - RNA, 1449 nt, synthetic construct
  misc_feature 1..1449: note = derived and/or modified CDS sequence (opt3) from CCHFV(K168_125)__KX013461.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctaactaccagcaggcagccctgaagtggaggaaggatattgggttccgggtgaatgctaacaccgccgcgctaagccacaaagtcctcgcagagtataaggtgccgggagacatcgtaatgagtgttaaagaaatgctgtccgatatgatacgccgacgtaatcttatcctgaacagaggcggtgacgagaatcccagggggcctgtgtctcgggaacatgtcgagtggtgtcgcgagtttgtgaagggaaaatacattatggccttcaacccaccctggggcgatatcaataagagcggcagatccgggattgctttggtggccacaggactcgcaaaactggctgaaaccgagggtaagggcgtctttgacgaagccaagaaaactgttgaggcgctgaacgggtatctcgataagcacaaagacgaagtggacaaggcctcagcagataacatgatcacaaatttactgaaacatatagctaaggcccaagagctttacaagaacagtagcgctttgagggcccagggagcacagattgacaccgccttctcttcctactattggctgtacaaagctggcgtaacgtcagagacttttcctaccgtgagccagttcctattcgaactcggtaagcaaccacgggggactaaaaagatgaaaaaggcgctgcttagtacacccatgaagtggggcaaaaagctgtatgagttgtttgcagatgactctttccagcagaatcgcatctacatgcaccctgccgtcctcaccgctggacgaatttccgaaatgggcgtgtgctttgggacaatcccagttgccaacccggatgacgcagcccagggaagcggtcataccaaatcgatcctgaatttaagaacgaacactgagacaaataacccctgtgctaagaccattgtgaaactgttcgaaatacaaaagactggctttaatatccaggatatggacattgtcgcctctgagcacctccttcaccagtccctggtggggaagcaatcacctttccagaacgcatataatgtaaaaggaaacgcgacaagtgctaatatcatatga

SEQ ID NO: 5959 - RNA, 1449 nt, synthetic construct
  misc_feature 1..1449: note = derived and/or modified CDS sequence (opt3) from CCHFV(K168_40)__KX013458.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctaactaccagcaggcagccctgaagtggaggaaggatattgggttccgggtgaatgctaacaccgccgcgctaagccacaaagtcctcgcagagtataaggtgccgggagacatcgtaatgagtgttaaagaaatgctgtccgatatgatacgccgacgtaatcttatcctgaacagaggcggtgacgagaatcccagggggcctgtgtctcgggaacatgtcgagtggtgtcgcgagtttgtgaagggaaactacattatggccttcaatccaccctggggcgatatcaacaaaagcggcagatccgggattgctttggtggccacaggactcgcaaagctggctgaaaccgagggtaaaggcgtctttgacgaagccaagaagactgttgaggcgctgaacgggtatctcgataaacacaaggacgaagtggacaaagcctcagcagataatatgatcacaaacttactgaagcatatagctaaagcccaagagctttacaagaatagtagcgctttgagggcccagggagcacagattgacaccgccttctcttcctactattggctgtacaaggctggcgtaacgtcagagacttttcctaccgtgagccagttcctattcgaactcggtaaacaaccacgggggacaaagaaaatgaagaaagcgctgcttagtactcccatgaagtggggaaagaaactgtatgagttgtttgcagatgactctttccagcagaaccgcatctacatgcaccctgccgtcctcaccgctggccgaatttccgaaatgggcgtgtgctttgggacaatcccagttgccaatccggatgacgcagcccagggaagcggtcataccaagtcgatcctgaacttaagaacgaatactgagacaaacaatccctgtgctaaaaccattgtgaagctgttcgaaatacagaaaactggctttaacatccaagatatggacattgtcgcctctgagcacctccttcaccagtccctggtggggaagcaatcacctttccagaatgcatataacgtaaagggaaatgcgacaagtgctaacatcatatga

SEQ ID NO: 5960 - RNA, 1449 nt, synthetic construct
  misc_feature 1..1449: note = derived and/or modified CDS sequence (opt3) from CCHFV(K323_27)__KX013473.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcacaattaagtcatgggacgaaaactatgccgagttgaaagtcgatgtgccaaagatcgagcagttagctaattaccagcaggcagccctgaagtggagaaaagacattgggttcagggttaacgctaatactgccgcgctaagcaacaaggtgctcgcagaatataaagtcccgggagagatcgtgatgagtgtaaaggaaatgctgtccgatatgatacggcgccgaaatcttatcctgaaccgtggcggtgacgagaatcccagagggcctgtttctagggaacacgtggagtggtgtcgggagtttgtcaaaggaaagtacattatggccttcaacccaccctggggcgatatcaacaaaagcggccgctccgggattgctttggtggccaccggactcgcaaagctggctgaaacagagggtaagggcgtgtttgacgaagccaaaaagaccgtcgaggcgctgaatgggtatctcgataaacatagagacgaagttgacaaggcctcagcagatagtatgatcactaacttactgaaacacatagctaaggcccaagagctttacaagaatagctctgctttgagggcccagggagcacagattgacacacctttctcctcattttactggctgtataaagccggcgtgaccccagagacgttccccactatcagccagttcctatttgaactcggtaagcaacctcgggggaccaaaaagatgaaaaaggctctgcttagtacaccaatgaagtggggcaaaaagctgtacgagttgttcgcggatgactcttttcagcagaaccgcatttatatgcatccggcagtactcactgccggacgaatctccgaaatgggcgtgtgcttcgggaccatccccgtcgctaatcctgatgacgccgcacagggaagcggtcacacaaaatcgattctgaacttaagaacctctacggagactaataacccatgtgccaagacaatagtgaaactgtttgaaatccaaaagaccggcttcaatattcaggatatggacatcgttgcttccgagcatctccttcaccagtcactggtggggaagcaaagtccctttcagaacgccttcaatgtcaaaggaaacgcaactagcgcgaatataatttga

SEQ ID NO: 5961 - RNA, 1449 nt, synthetic construct
  misc_feature 1..1449: note = derived and/or modified CDS sequence (opt3) from CCHFV(Min)__KX013482.1__N
  source 1..1449: mol_type = other RNA
atggagaacaagatcgaagtgaatagcaaagacgagatgaacaagtggttcgaagagtttaaaaagggcaatgggctgatggatactttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcacaattaagtcatgggacgaaaactatgccgagttgaaagtcgatgtgccaaagatcgagcagttagctaattaccagcaggcagccctgaagtggagaaaagacattgggttcagggttaacgctaatactgccgcgctaagcaacaaggtgctcgcagaatataaagtcccgggagagatcgtgatgagtgtaaaggaaatgctgtccgatatgatacggcgccgaaatcttatcctgaaccgtggcggtgacgagaatcccagagggcctgtttctagggaacacgtggagtggtgtcgggagtttgtcaaaggaaagtacattatggccttcaacccaccctggggcgatatcaacaaattgggccgcagcgggattgctctcgtggccaccggactggcaaagctggctgaaacagagggtaagggcgtgtttgacgaagccaaaaagaccgtcgaggcgctcaatgggtatttagataaacatagagacgaagttgacaaggcctccgcagattcaatgatcactaacctgcttaaacacatagctaaggcccaagagttgtacaagaatagtagcgctctgagggcccagggagcacagattgacacacctttctcttccttttactggctatataaagccggcgtgaccccagagacgttccccactatctcacagttcctctttgaactgggtaagcaacctcgggggaccaaaaagatgaaaaaggctctcctgagcacaccaatgaagtggggcaaaaagttgtacgagcttttcgcggatgacagttttcagcagaaccgcatttatatgcatccggcagtactgactgccggacgaatctctgaaatgggcgtgtgcttcgggaccatccccgtcgctaatcctgatgacgccgcacagggatccggtcacacaaaaagcattttaaacctgagaacctcgacggagactaataacccatgtgccaagacaatagtgaaactctttgaaatccaaaagaccggcttcaatattcaggatatggacatcgttgcttctgagcatcttctgcaccagtccttggtggggaagcaatcaccctttcagaacgcctacaatgtcaaaggaaacgcaaccagtgcgaatataatttga

SEQ ID NO: 5962 - RNA, 1449 nt, synthetic construct
  misc_feature 1..1449: note = derived and/or modified CDS sequence (opt3) from CCHFV(Saf)__KX013488.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcacaattaagtcatgggacgaaaactatgccgagttgaaagtcgatgtgccaaagatcgagcagttagctaattaccagcaggcagccctgaagtggagaaaagacattgggttcagggttaacgctaatactgccgcgctaagcaacaaggtgctcgcagaatataaagtcccgggagagatcgtgatgagtgtaaaggaaatgctgtccgatatgatacggcgccgaaatcttatcctgaaccgtggcggtgacgagaatcccagagggcctgtttctagggaacacgtggagtggtgtcgggagtttgtcaaaggaaagtacattatggccttcaacccaccctggggcgatatcaacaaaagcggccgctccgggattgctttggtggccaccggactcgcaaagctggctgaaacagagggtaagggcgtgtttgacgaagccaaaaagaccgtcgaggcgctgaatgggtatctcgataaacatagagacgaagttgacaaggcctcagcagatagtatgatcactaacttactgaaacacatagctaaggcccaagagctttacaagaatagctctgctttgagggcccagggagcacagattgacacacctttctcctcattttactggctgtataaagccggcgtgaccccagagacgttccccactatcagccagttcctatttgaactcggtaagcaacctcgggggaccaaaaagatgaaaaaggctctgcttagtacaccaatgaagtggggcaaaaagctgtacgagttgttcgcggatgactcttttcagcagaaccgcatttatatgcatccggcagtactcactgccggacgaatctccgaaatgggcgtgtgcttcgggaccatccccgtcgctgatcctgacgatgccgcacagggaagcggtcacacaaaatcgattctgaatttaagaacctctacggagactaacaatccatgtgccaggacaatagtgaagctgtttgaaatccagaaaaccggcttcaacattcaagacatggatatcgttgcttccgagcatctccttcaccagtcactggtggggaagcaaagtccctttcagaatgcctacaacgtcaagggaaatgcaactagcgcgaacataatttga

SEQ ID NO: 5963 - RNA, 1449 nt, synthetic construct
  misc_feature 1..1449: note = derived and/or modified CDS sequence (opt3) from CCHFV(UCCR4459)__KY484031.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctgggtaccagcaggcagccctgaagtggaggaaggatattggattccgggtgaacgctaataccgccgcgctaagccacaaagtcctcgcagagtataaggtgccgggcgaaatcgtaatgagtgttaaagagatgctgtccgacatgatacgccgacgtaaccttatcctgaatagaggtggggatgaaaaccccaggggacctgtgtctcgggagcatgtcgagtggtgtcgcgaatttgtgaagggcaaatacattatggccttcaatccaccctggggcgacatcaacaagttggggagaagcggaattgctctcgtggccacaggtctggcaaaactggctgagaccgaaggcaagggggtctttgatgaggccaagaaaactgttgaagcgctcaatggatatttagacaagcacaaagatgaggtggacaaggcctccgcagacaacatgatcacaaacctgcttaaacatatagctaaggcccaagagttgtacaaaaattcaagtgctctgagggcccagggcgcacagattgataccgccttcagctcttactattggctatacaaagctggtgtaacgcctgaaacttttccaaccgtgtcccagttcctcttcgagctggggaagcaaccccggggaacaaagaagatgaaaaaggcgcttctgtcaactcctatgaagtggggcaaaaagttgtatgaactctttgcagacgatagcttccagcagaaccgcatctacatgcacccagccgtcctgaccgctggccgaattagtgagatgggggtgtgctttggaacaatcccggttgccaatcccgacgatgcagcccagggttctggccataccaaatccatcttaaacctgagaacgaatactgaaacaaacaatccttgtgctaagaccattgtgaaactcttcgagatacaaaagactgggtttaacatccaggacatggatattgtcgccagcgagcaccttctgcaccagtcgttggtgggaaagcaatctccattccagaatgcatataacgtaaaaggcaatgcgacatccgctaacatcatatga

SEQ ID NO: 5964 - RNA, 1449 nt, synthetic construct
  misc_feature 1..1449: note = derived and/or modified CDS sequence (opt3) from CCHFV(YL16070)__KY354080.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctgattaccagcaggcagccctgaagtggaggaaggacattgggttccgggtgaacgctaataccacagccctaagccacaaagtcctcgcggagtataaggtgccgggagaaatcgtaatgagtgttaaagagatgctgtccgatatgatacgccgacgtaaccttatcctgaatagaggcggtgacgaaaaccccagggggcctgtgtctcgggagcatgtcgagtggtgtcgcgaatttgtgaagggaaaatacattatggcattcaatccaccctggggcgatatcaacaagagcggcagatccgggattgccttggtggctaccggactcgccaaactggcagagactgaaggtaagggcgtctttgacgaggctaagaaaacagttgaagccctgaatgggtatctcaacaagcacaaagatgaggtggacaaggcgtcagccgacagtatgatcaccaacttactgaaacatatagcaaaggctcaagagctttacaagaatagctctgccttgagggctcagggagcccagattgatacggcattctcctcatactattggctgtacaaagccggcgtaactcctgaaacctttccaacagtgagccagttcctattcgagctcggtaagcaaccccgggggactaaaaagatgaaaaaggctctgcttagtacccctctgaagtggggaaaacgcttgtatgaactctttgcggacgattctttccagcagaaccgaatctacatgcacccagcagtcctgacagccggcagaatttccgagatgggcgtgtgctttgggaccatcccggttgctaatcccgacgatgccgcacagggaagcggtcatacgaagtcgatcttaaacctgaggactaatacagaaaccaacaatccttgtgccaaaactattgtgaaactcttcgagatacaaaagacaggctttaacatccaggacatggatattgtcgcttctgagcaccttctgcaccagtccttggtggggaagcaatcaccattccagaatgcctataacgtaaagggaaatgcaaccagtgcgaacatcatatga

SEQ ID NO: 5965 - RNA, 1449 nt, synthetic construct
  misc_feature 1..1449: note = derived and/or modified CDS sequence (opt3) from CCHFV(66019)__AJ010648.1__N
  source 1..1449: mol_type = other RNA
atggagaacaagatcgaagtgaataacaaagacgagatgaatagatggttcgaagagtttaagaaaggcaacgggctggtcgataccttcacaaatagctactccttttgcgaatctgttcccaacctcgacaggttcgtgtttcagatggcctcagctactgatgacgcacaaaaggatagtatttatgccagcgcgcttgtagaggctacgaaattctgtgcccctatatacgagtgcgcatgggtgtcctctaccggaatcgtcaagaagggtctggaatggtttgagaaaaatgccggcacaattaagtcgtgggacgaatcatatactgagttgaaagtggaggttccaaagatcgaacagttagctagctaccagcaggcagccctgaaatggcggaaggatattgggttccgcgtgaacgctaataccgccgcgctaagtcacaaggtcctcgcagagtataaagtgccgggagaaatcgtaatgtccgttaaggagatgctgtctgacatgatacgacgtagaaaccttatcctgaataggggcggtgatgaaaacccccgggggcctgtgagccgcgagcatgtcgagtggtgtagagaatttgtgaaaggaaagtacattatggccttcaatccaccctggggcgacatcaacaaatccggcaggtcagggattgctttggtggccacaggactcgcaaagctggctgagaccgaaggtaaaggcgtctttgatgaggccaagaagactgttgaagcgctgaatgggtatctcgacaaacacaaggatgaggtggacaaagccagtgcagacaacatgacaaccaacttactgaagcatatcgctaaagcccaagagctttacaagaatagctctgctttgcgggcccagggagcacagatagatacggccttctcctcatactattggctgtacaaggctggcgtaactcctgaaacctttccaacagtgagccagttcctattcgagctcggtaaacaaccccgcgggactaagaaaatgaagaaagcgctgcttagtacccctatgaagtggggaaagaaactgtatgaattgtttgcagacgattctttccagcagaaccgaatttacatgcacccagccgtcctcacagctggcagaatctccgagatgggcgtgtgctttgggaccattccggttgccgaccccgatgacgcagcccagggaagcggtcatacgaagtcgatcctgaatttaaggactaacacagaaaccaataacccttgtgctaaaactatcgtgaagctgttcgagattcagaaaacaggctttaatatacaagatatggacatcgtcgcctctgagcacctccttcaccagtccctggtggggaagcaatcaccattccagaacgcatataatgtaaagggaaacgcgaccagtgctaatattatctga

SEQ ID NO: 5966 - RNA, 1449 nt, synthetic construct
  misc_feature 1..1449: note = derived and/or modified CDS sequence (opt3) from CCHFV(8402)__AJ010649.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgagagattcgtgtttcagatggcctcagctactgacgatgcacaaaaagacagtatttatgccagcgcgcttgtagaggctacgaagttctgtgcccctatatacgaatgcgcatgggtgtcctctaccggaatcgtcaagaaaggtctggagtggtttgaaaagaatgccggcacaattaaatcgtgggatgagtcatatactgagttgaaggtggaagttccaaaaatcgagcagttagctaactaccagcaggcagccctgaagtggaggaaggacattgggttccgggtgaatgctaacaccgccgcgctaagccacaaagtcctcgcagaatataaggtgccgggagagatcgtaatgagtgttaaagaaatgctgtccgatatgatacgccgacgtaatcttatcctgaacagaggcggtgacgagaatcccagggggcctgtgtctcgggagcatgtcgaatggtgtcgcgagtttgtgaagggaaaatacattatggccttcaacccaccctggggcgatatcaataagagcggcagatccgggattgctttggtggccacaggactcgcaaaactggctgaaaccgagggtaagggcgtctttgacgaagccaagaaaactgttgaggcgctgaacgggtatctcgataagcacaaagacgaggtggataaggcctcagcagacaacatgatcacaaatttattcaaacatatagctaaggcccaagaactgtacaagaaccttagtgctttgggagcccagggcgcacagattgacaccgcctttagctcttactattggctgtacaaagctggtgtaacgcctgagactttcccaaccgtgtcccagttcctatttgaactcgggaagcaacccaggggaactaaaaagatgaaaaaggcgctgctttcaacacctatgaagtggggcaaaaagctgtatgagttgttcgcagatgacagctttcagcagaatcggatctacatgcacccagccgtcctcaccgctggccgcattagtgaaatgggggtgtgcttcggaacaatcccggttgccaaccccgatgacgcagcccagggttctggccataccaaatccatcctgaatttacgaacgaacactgagacaaataacccttgtgctaagaccattgtgaaactgtttgagatacaaaagactgggttcaatatccaggatatggacattgtcgccagcgaacacctccttcaccagtcgctggtgggaaagcaatctccatttcagaacgcatataatgtaaaaggcaacgcgacatccgctaatatcatatga

SEQ ID NO: 5967 - RNA, 1449 nt, synthetic construct
  misc_feature 1..1449: note = derived and/or modified CDS sequence (opt3) from CCHFV(Bul/HU517)__AY277676.2__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcgccattaagtcatgggacgaaaactatgtcgagttgaaagtggatgttccaaagatcgagcagttagctaattaccagcaggcagccctgaagtggagaaaagacattgggttcagggtgaacgctaatacagccgcgctaagcaacaaggtcctcgcagaatataaagtgccgggagagatcgtaatgagtgttaaggaaatgctgtccgatatgatacggcgccgaaatcttatcctgaaccgtggctctgacgagaatcccagaggtcctgtgagccacgaacatgtcgagtggtgtagggagtttgtgaaagggaagtacattatggccttcaacccaccctggggagatatcaacaaatccggccggtcaggcattgctttggtggccactgggctcgcaaagctggctgaaaccgagggaaagggtgtctttgacgaagccaaaaagacagttgaggcgctgaatggctatctcgataaacaccgcgacgaagtggacaaggccagtgcagatagcatgatcaccaacttactgaaacatatagctaaggcccaagagctttacaagaatagctccgctttgagagcccagggggcacagattgacactcctttctcatctttttactggctgtataaagccggagtaacaccagagaccttccccacgatcagtcagttcctatttgaactcggcaagcaacctaggggtactaaaaagatgaaaaaggctctgctttctaccccaatgaagtgggggaaaaagctgtacgagttgttcgcggatgactcctttcagcagaaccggatttatatgcacccggcagtgctcacagccggacgcatcagcgaaatgggcgtctgcttcggcactatccccgtggctaatcctgatgacgccgcacaggggtcgggacataccaaatctattctgaacttacgaacatccaccgagacgaataacccatgtgccaagactatagttaaactgtttgaaatccaaaagacaggtttcaatattcaggatatggacatcgtggcttcagagcacctccttcaccagagtctggtcggcaagcaaagcccctttcagaacgcctacaatgtgaaagggaacgcaacctccgcgaatataatttga

SEQ ID NO: 5968 - RNA, 1449 nt, synthetic construct
  misc_feature 1..1449: note = derived and/or modified CDS sequence (opt3) from CCHFV(V46/13)__KR011837.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcacaattaagtcatgggacgaaaactatgccgagttgaaagtcgatgtgccaaagatcgagcagttagctaattaccagcaggcagccctgaagtggagaaaagacattgggttcagggttaacgctaatactgccgcgctaagcaacaaggtgctcgcagaatataaagtcccgggagagatcgtgatgagtgtaaaggaaatgctgtccgatatgatacggcgccgaaatcttatcctgaaccgtggctctgacgagaatcccagaggtcctgttagcagggaacacgtggagtggtgtcgggagtttgtcaaagggaagtacattatggccttcaacccaccctggggagatatcaacaaatccggccgctcaggcattgctttggtggccaccgggctcgcaaagctggctgaaacagagggaaagggtgtgtttgacgaagccaaaaaggcggtcgaggccctgaatggctatctcgataaacatagagacgaagttgtgaaggcaagtgctgacagcatgatcaccaacttactgaaacacatagccaaggctcaagagctttacaagaatagctccgccttgagggcacagggggcccagattgatactcctttctcatctttttactggctgtataaagctggagtaacaccagagaccttccccacgatcagtcagttcctatttgaactcggcaagcaacctcggggtactaaaaagatgaaaaaggcgctgctttctaccccaatgaagtgggggaaaaagctgtacgagttgttcgcagacgattcctttcagcagaaccgcatttatatgcatccggccgtgctcacagctggacgaatcagcgaaatgggcgtctgcttcggcactatccccgtggccaatcctgacgatgcagcccaggggtcgggacacaccaaatctattctgaacttaagaacatccaccgagacgaataacccatgtgctaagactatagttaaactgtttgaaatccaaaagacaggtttcaatattcaggacatggatatcgtggcctcagagcatctccttcaccagagtctggtcggcaagcaaagcccctttcagaacgcatacaatgtgaaagggaacgcgacctccgctaatataatttga

SEQ ID NO: 5969 - RNA, 1449 nt, synthetic construct
  misc_feature 1..1449: note = derived and/or modified CDS sequence (opt3) from CCHFV(1231-CR/TI-2015)__KU161587.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcacaattaagtcatgggacgaaaactatgccgagttgaaagtcgatgtgccaaagatcgagcagttagctaattaccagcaggcagccctgaagtggagaaaagacattgggttcagggttaacgctaatactgccgcgctaagcaacaaggtgctcgcagaatataaagtcccgggagagatcgtgatgagtgtaaaggaaatgctgtccgatatgatacggcgccgaaatcttatcctgaaccgtggcggtgacgagaatcccagagggcctgtttctagggaacacgtggagtggtgtcgggagtttgtcaaaggaaagtacattatggccttcaacccaccctggggcgatatcaacaaaagcggccgctccgggattgctttggtggccaccggactcgcaaagctggctgaaacagagggtaagggcgtgtttgacgaagccaaaaagaccgtcgaggcgctgaatgggtatctcgataaacatagagacgaagttgacaaggcctcagcagatagtatgatcactaacttactgaaacacatagctaaggcccaagagctttacaagaatagctctgctttgagggcccagggagcacagattgacacacctttctcctcattttactggctgtataaagccggcgtgaccccagagacgttccccactatcagccagttcctatttgaactcggtaagcaacctcgggggaccaaaaagatgaaaaaggctctgcttagtacaccaatgaagtggggcaaaaagctgtacgagttgttcgcggatgactcttttcagcagaaccgcatttatatgcatccggcagtactcactgccggacgaatctccgaaatgggcgtgtgcttcgggaccatccccgtcgctaatcctgatgacgccgcacagggaagcggtcacacaaaatcgattctgaacttaagaacctctacggagactaataacccatgtgccaagacaatagtgaaactgtttgaaatccaaaagaccggcttcaatattcaggatatggacatcgttgcttccgagcatctccttcaccagtcactggtggggaagcaaagtccctttcagaacgcctacaatgtcaaaggaaacgcaactagcgcgaatataatttga

SEQ ID NO: 5970 - RNA, 1449 nt, synthetic construct
  misc_feature 1..1449: note = derived and/or modified CDS sequence (opt3) from CCHFV(AP92)__U04958.1__N
  source 1..1449: mol_type = other RNA
atggagaacaagatcgaagtgaatagcaaagacgatctgaacaagtggttcgaggaatttaaaaagggcaatgggctcgtcgacaccttcacaaactcctactctttttgcgagaatgttcccaaccttgatagattcgtgtatcagatggcctcagctactgacgatgcacaaaaagacagtatttacgccagcgcgctggtagaagctacgaagtattgtgcccctatatacgagtgcgcatgggtgtcctctaccggaatcgtcaagaaaggtttggagtggtttgaaaagaatacatcgactattaaatcatgggatgagagctataccgaattaaaggtggacatcccaaaaattgagcagctgagttcctaccagcaggccgctctaaagtggaggaaggatatcggcttccggataaacgcaaatacaaccgccctctctaacaaagttctggctgagtataaggtgccgggggaaatccttgtccccgtgaaagagatgctgagcgacatgattcgccgacgtaatatcattttgaacagaggatccgatgaaaatcctaggggcccagtatcacacgagcatatcgaatggtgtcgggagtttataaagggtaaatacattatggccttcaatcccccttggggagacatcaacaagagtgggcgcagcggcattgcgctcgttgcaactggcctggccaaactggctgagacagaagggaagggagtgtttgaggaagccaagaaaaccgtcgaggcactcaaggattacttagacaaacacagagacgaagtggataagacgtctgctgacaacatggtgacttccctgcttaaacatatcgccaaggcgcaagagttgtataagaactcaagcgccctgagggcacagggtgctcagatcgataccccattcagttctttttactggctatataaagccggcgtcacacccgagactttccctaccgtttcccagtttctcttcgaactggggaagcaaccacggggaaccaaaaagatgaaaaaggcccttctgagcacaccgatgaagtggggcaaaaagcactacgagttgttcgctgacgattcgtttcagcagaatcgcatttatatgcatcccgcagtgctcacggccggtcgaatatctgaaatgggggtatgcttcggaactatccctgtggctaacccagacgatgcggcacagggctccggccacacaaaatcaattctgaatttaagaaccaacactgagagtaataacccctgtgccaggacaatcgtcaagctgtttgaaatacagaaaaccgggttcgacattaaggatatggacatcgtggctagcgagcacctccttcatcaatccctggttggaaagcagtctccttttcaaaatgcctacaacgtgaaaggtaatgcaacgagcgccaacatcatttga

SEQ ID NO: 5971 - RNA, 1449 nt, synthetic construct
  misc_feature 1..1449: note = derived and/or modified CDS sequence (opt3) from CCHFV(C68031)__M86625.1__N
  source 1..1449: mol_type = other RNA
atggagaacaagatcgaagtgaataacaaagacgagatgaataagtggttcgaagagtttaaaaagggcaacgggctggtcgataccttcacaaatccctacagcttttgcgaatccgttcctaacctcgagagattcgtgtttcagatggcctctgctactgacgatgcacaaaaagactcaatttatgccagtgcgcttgtagaggctacgaagttctgtgccccaatatacgaatgcgcatgggtgagctccaccggaatcgtcaagaaaggtctggagtggtttgaaaagaatgccggcacaattaaatcttgggatgagtcgtatatcgagttgaaggtggaagttccgaaaattgagcagttagctaactaccagcaggcagccctgaagtggaggaaggacatcgggttccgggtgaatgctaacactgccgcgctatcacacaaagtcctcgcagaatataaggtgcccggagagatagtaatgagcgttaaagaaatgctgagtgatatgatccgccgacgtaatcttattctgaacagaggcggtgacgagaatcctagggggccagtgtcccgggagcatgtcgaatggtgtcgcgagtttgtgaagggaaaatacatcatggccttcaatcccccttggggcgatattaacaagtctggcagaagcgggatcgctttggtggccaccggactcgcaaaactggctgaaacagagggtaagggcgtctttgacgaagccaagaaaaccgttgaggcgctgaacgggtatctcgataagcacaaagacgaggtggataaggcctccgcagacaacatgataactaatttactgaaacatattgctaaggcccaagaactttacaagaactcaagtgctttgagggcccagggagcacagatcgacacagccttcagctcttactattggctgtacaaagctggcgtaaccccagagacgtttcccactgtgtcccagttcctattcgaactcggtaagcaacctcgggggaccaaaaagatgaaaaaggcgctgctttcaacaccaatgaagtggggcaaaaagctgtatgagttgtttgcagatgacagcttccagcagaatcgcatttacatgcacccggccgtcctcactgctggacgaatcagtgaaatgggcgtgtgctttgggaccatccccgttgccaaccctgatgacgcagcccagggatctggtcatacaaaatccattctgaatttaagaaccaacacggagactaataacccatgtgctaagacaatagtgaaactgttcgagatccaaaagaccggctttaatattcaggatatggacatcgtcgccagcgaacacctccttcaccagtcgctggtggggaagcaatctcccttccagaacgcatataatgtaaaaggaaacgcgacttccgctaatataatttga

SEQ ID NO: 5972 - RNA, 1449 nt, synthetic construct
  misc_feature 1..1449: note = derived and/or modified CDS sequence (opt3) from CCHFV(1-CR/HU-2015)__KU161586.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttatcagatggcctcagctactgatgacgcacaaaaggatagtatttacgccagcgcgcttgtggaggctacgaagttttgtgcccctatatatgagtgcgcatgggtatcctctaccggaatcgtgaaaaagggtctggaatggttcgagaaaaattcgggcacaattaagtcatgggacgaaaactacgccgagttgaaagtcgatgtgccaaagatcgagcagttagctaattatcagcaggcagccctgaagtggagaaaagacattgggtttagggttaacgctaatactgccgcgctaagcaacaaggtgctcgcagaatacaaagtcccgggagagatcgtgatgagtgtaaaggaaatgctgtccgatatgatacggcgccgaaatcttatcctgaaccgtggcggtgacgagaatcccagagggcctgtttctagggaacacgtggagtggtgtcgggagttcgtcaaaggaaagtatattatggcctttaacccaccctggggcgatatcaacaaaagcggccgctccgggattgctttggtggccaccggactcgcaaagctggctgaaacagagggtaagggcgtgttcgacgaagccaaaaagaccgtcgaggcgctgaatgggtacctcgataaacatagagacgaagttgacaaggcctcagcagatagtatgactacaaacttactgaaacacatcgctaaggcccaagagctttacaagaatagctctgctttgagggcccagggagcacagatagacacccctttttcctcattctattggctgtacaaagccggcgtgacgccagagacttttcccaccattagccagttcctattcgaactcggtaagcaacctcgggggactaaaaagatgaaaaaggctctgcttagtacaccaatgaagtggggcaaaaagctgtatgagttgtttgcggatgactctttccagcagaaccgcatctacatgcatccggcagtactcaccgccggacgaatttccgaaatgggcgtgtgctttgggacaatccccgtcgctaatcctgatgacgccgcacagggaagcggtcacaccaaatcgatcctgaacttaagaacgtctactgagacaaataacccatgtgccaagaccattgtgaaactgttcgaaatacaaaagactggctttaatatccaggatatggacattgttgcttccgagcatctccttcaccagtcactggtggggaagcaaagtcccttccagaacgcctataatgtcaaaggaaacgcaacaagcgcgaatatcatatga

SEQ ID NO: 5973 - RNA, 1449 nt, synthetic construct
  misc_feature 1..1449: note = derived and/or modified CDS sequence (opt3) from CCHFV(36-ST-2014)__KR814838.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaatacaggcactattaagtcgtgggacgataactatgccgaattgaaagtcgacgtgccaaagatcgagcagttagctaattaccagcaggcagccctgaagtggagaaaagatattgggttcagggttaacgctaataccgccgcgctatcaaacaaggtgctcgcagagtataaagtcccgggagaaatcgtgatgagcgtaaaggagatgctgagtgacatgatacggcgccgaaatcttatcctgaaccgtggcggtgatgggaatcccagaggacctgtttcccacgaacatgtggagtggtgtagggaatttgtcaaaggcaagtacattatggccttcaacccaccctggggcgacatcaacaaatctgggcggagcggaattgctttggtggccacaggtctcgcaaagctggctgagaccgagggcaagggggtgtttgatgaagccaaacgcactgtcgaggcgctgaatggatatctcgacaagcacagagacgaagttgataaagcctccgcagactcaatgatcacaaacttactgaagcatatagctaaagcccaagagctttacaagaatagtagcgctttgagggcccagggcgcacagattgatacccctttctcttccttttactggctgtataaggccggtgtgacgccagaaactttccccaccatctcacagttcctatttgagctcgggaaacaacctcggggaacaaagaaaatgaagaaagctctgcttagcactccaatgaagtggggcaagaaactgtacgagttgttcgcggacgatagttttcagcagaaccgcatttatatgcacccggcagtactcaccgccggccgaatctctgaaatgggggtgtgcttcggaacaatccccgtcgctaatcctgacgatgccgcacagggttccggccataccaagagcattctgaacttaagaacgtcgactgagacaaataacccatgtgccaaaaccatagtgaagctgtttgaaatccagaaaactgggttcaatattcaagacatggatatcgttgcttctgagcacctccttcaccagtccctggtgggaaagcaatcaccctttcagaacgcctacaatgtcaagggcaacgcaacaagtgcgaatataatttga

SEQ ID NO: 5974 - RNA, 1449 nt, synthetic construct
  misc_feature 1..1449: note = derived and/or modified CDS sequence (opt3) from CCHFV(37-ST-2009)__KR814835.1__N
  source 1..1449: mol_type = other RNA
atggagaacaagatcgtggtcaatagcaaagacgaaatgaacaagtggttcgaggaatttaaaaaggttaatggcctggtggataccttcacaaactcctactctttttgcgagaatgtacccaacctcgacaaattcgtgtttcagatggcctcagctactgatgacgcacaaaaggatagtatttatgccagcgcgcttgtcgaagctacgaagttctgtgcccctatatacgagtgcgcatgggtgtcctctaccgggatcgttaaaaagggactggagtggtttgaaaagaatgccggtacaattaagtcgtgggacgagtcatatactgaattgaaagtggatgtcccaaagatcgagcagttagctagctaccagcaggcagccctgaagtggagaaaagacattggcttcagggtgaacgctaataccgccgcgctaagttccaaggtactctctgagtataaagttccgggggaagtggtcatgcccgtgaaggagatgctgagcgatatgatccggcgccgaaaccttatactgaatcgtggatccgacgaaaaccctagaggcccagtgtcaagggagcacgtcgaatggtgtcgggagtttgttaaaggtaagtacatcatggcattcaatcccccttggggagatattaacaaaagtgggcgcagcggcatcgccttggtggctacaggcctcgccaagctggcagagaccgaagggaagggaatttttgaggaagctagaaaaactgtagacgccctgaaggattatctcgacaggcataaagaggaagtggacaagacaaatgcggataacatggtcaccaacttattcaaacacatcgccaaggcacaagagctgtacaaaaattcttccgcccttcgggctcagggtgctcagatagacacgccatttagctcattctactggttgtataaagccggcgtgactcccgagaccttccctacagttagtcagtttctgttcgaactagggaagcaaccacgcggaactcgaaaaatgaagaaagcactcctgtctaccccgatgaagtggggcaagaaactttacgagctgtttgccgatgactccttccagcagaacagaatttatatgcatcccgctgtgttgacagcgggtagggtcagcgaaatgggggtgtgctttggaaccatccctgtagataatccagacgatgcagcccagggctcgggccacacgaagtctattctcaacctgcggacttccgctgagacaaataacccctgtgcccgtaccatcgttaaattattcgaaatccaaaaggcagggtttaatattcaggagatggacatagtggcctcagagcatctgctccaccagagtcttgtcggaaaacaaagccctttccagaacgcttacaatgtgaagggtaacgccacttccgcaaatatcatttga

SEQ ID NO: 5975 - RNA, 1449 nt, synthetic construct
  misc_feature 1..1449: note = derived and/or modified CDS sequence (opt3) from CCHFV(59-TK-2012)__KR814833.1__N
  source 1..1449: mol_type = other RNA
atggagaacaagatcgtggtcaatagcaaagacgaaatgaacaagtggttcgaggaatttaaaaaggttaatggcctggtggataccttcacaaactcctactctttttgcgagaatgtacccaacctcgacaaattcgtgtttcagatggcctcagctactgatgacgcacaaaaggatagtatttatgccagcgcgcttgtcgaagctacgaagttctgtgcccctatatacgagtgcgcatgggtgtcctctaccgggatcgttaaaaagggactggagtggtttgaaaagaatacaggtactattaagtcgtgggacgagtcatataccgaattgaaagtggatgtcccaaagatcgagcagttagccagctaccagcaggctgcactgaagtggagaaaagacattggcttcagggtgaacgccaatacagctgccctaagttccaaggtactctctgagtataaagttccgggggaaatcgtgatgcccgtcaaggagatgctgagcgatatgatacggcgccgaaaccttatcctgaatcgtggatccgacgaaaaccctagaggcccagtgtcaagggagcacgtggaatggtgtcgggagtttgtcaaaggtaagtacattatggcgttcaatcccccttggggagatatcaacaaaagtgggcgcagcggcattgcattggttgccaccggcctcgctaagctggccgagactgaagggaagggaatctttgaggaagcaagaaaaacagtggacgctctgaaggattatctcgacaggcataaagaggaagtagacaagaccaatgccgataacatggtgacgaacttattcaaacacatagcgaaggcccaagagctgtacaaaaattcttccgcacttcgggctcagggtgcccagattgacactccatttagctcattctactggttgtataaagctggcgtcacccccgagacattccctactgtgagtcagtttctgttcgaactagggaagcaaccacgcggaacccgaaaaatgaagaaagccctcctgtctacaccgatgaagtggggcaagaaactttacgagctgtttgcagatgactccttccagcagaacagaatctatatgcatcccgccgttttgaccgctggtaggattagcgaaatgggggtgtgctttggaacgatccctgtcgataatccagacgatgcggcacagggctcgggccacactaagtctatcctcaacctgcggacatccgccgagaccaataacccctgtgctaaaactattgtgaagttattcgaaatacaaaaagccgggtttaatatccaggagatggacattgtagcatcagagcatctgctccaccagagtcttgttggaaagcaaagccctttccagaacgcctacaatgtgaagggtaacgctacatccgccaatatcatatga

SEQ ID NO: 5976 - RNA, 1449 nt, synthetic construct
  misc_feature 1..1449: note = derived and/or modified CDS sequence (opt3) from CCHFV(73-ST-2013)__KR814836.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggcctcagctactgatgacgcacaaaaggatagtatttatgccagcgcgcttgtagaggctacgaagttctgtgcccctatatacgagtgcgcatgggtgtcctctaccggaatcgtcaaaaagggtctggaatggtttgagaaaaatgccggcacaattaagtcgtgggacgaatcatatactgagttgaaagtggatgttccaaagatcgagcagttagctaactaccagcaggcagccctgaagtggagaaaagacattgggttcagggtgaatgctaacaccgccgcgctaagcaataaggtcctcgcagaatataaagtgccgggagagatcgtaatgagtgttaaggaaatgctgtccgatatgatacggcgccgaaaccaaatccttaatcgtggcggtgacgagaaccccagagggcctgtgtctagggaacacgtcgattggtgtcgggagtttgtgaaaggaaagtacattatggccttcaatccaccctggggcgacatcaacaaaagcggccgctccgggattgctctggtggccacaggattggcaaagctcgctgagaccgaaggtaagggcgtctttgatgaggccaaaaagactgttgaagcgctgaacgggtatctggacaaacataaggacgaggtggatagagcctcagcagacagtatgatcacaaatctcttaaaacacatagctaaggcccaggaactgtacaagaacagctctgctcttagggcccagggagcacagattgataccgccttctcctcatactattggttgtacaaagctggcgtaacgcctgagacttttccaaccgtgagccaattcctgttcgagctaggtaagcagccccgggggactaaaaagatgaaaaaggcgctcctgagtacacctatgaagtggggaaagaaactttatgaactgtttgcagacgattctttccagcagaatcgcatctacatgcatccagccgtcttgaccgctggccgaatttccgagatgggcgtgtgctttgggacaatcccggttgccaaccccgacgatgcagcccaaggaagcggtcacaccaaatcgatcctcaatctgagaacgaacactgaaacaaataacccttgtgctaggaccattgtgaagttattcgagatacagaaaactggctttaatatccaggacatggatattgtcgcctctgaacatctgctccaccaatcccttgtggggaagcagtcaccattccagaacgcatataatgtaaagggaaacgcgacaagtgctaatatcatatga

SEQ ID NO: 5977 - RNA, 1449 nt, synthetic construct
  misc_feature 1..1449: note = derived and/or modified CDS sequence (opt3) from CCHFV(75-ST-2010)__KR814845.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcacaattaagtcatgggacgaaaactatgccgagttgaaagtcgatgtgccaaagatcgagcagttagctaattaccagcaggcagccctgaagtggagaaaagacattgggttcagggttaacgctaatactgccgcgctaagcaacaaggtgctcgcagaatataaagtcccgggagagatcgtgatgagtgtaaaggaaatgctgtccgatatgatacggcgccgaaatcttatcctgaaccgtggctctgacgagaatcccagaggtcctgttagcagggaacacgtggagtggtgtcgggagtttgtcaaagggaagtacattatggccttcaacccaccctggggagatatcaacaaatccggccgctcaggcattgctttggtggccaccgggctcgcaaagctggctgaaacagagggaaagggtgtgtttgacgaagccaaaaagaccgtcgaggcgctgaatggctatctcgataaacatagagacgaagttgacaaggccagtgcagatagcatgatcactaacttactgaaacacatagctaaggcccaagagctttacaagaatagctccgctttgagggcccagggggcacagattgacacacctttctcatctttttactggctgtataaagccggagtgaccccagagacgttccccactatcagtcagttcctatttgaactcggcaagcaacctcggggtaccaaaaagatgaaaaaggctctgctttctacaccaatgaagtgggggaaaaagctgtacgagttgttcgcggatgactcctttcagcagaaccgcatttatatgcatccggcagtactcactgccggacgaatcagcgaaatgggcgtgtgcttcggcaccatccccgtcgctaatcctgatgacgccgcacaggggtcgggacacacaaaatctattctgaacttaagaacctccacggagactaataacccatgtgccaagacaatagtgaaactgtttgaaatccaaaagaccggtttcaatattcaggatatggacatcgttgcttcagagcatctccttcaccagagtctggtgggcaagcaaagcccctttcagaacgcctacaatgtcaaagggaacgcaacttccgcgaatataatttga

SEQ ID NO: 5978 - RNA, 1449 nt, synthetic construct
  misc_feature 1..1449: note = derived and/or modified CDS sequence (opt3) from CCHFV(CHH)__KU707898.1__N
  source 1..1449: mol_type = other RNA
atggagaacaagatcgaagtgaatagcaaagacgagatgaacaagtggttcgaagagtttaaaaagggcaatgggctggtcgataccttcacaaactcctactctttttgcgaatcagttcccaatctcgacagattcgtgtttcagatggccagtgctactgatgacgcacaaaaagatagcatttatgcctccgcgcttgtagaggctacgaagttctgtgcccctatatacgagtgcgcatgggcctcttcgaccggaatcgtgaagaaaggtctggaatggtttgagaagaacgctggcacaattaaatcatgggacgaaagctatactgagttgaaggtcgaggtgccaaaaatcgaacagttaagtaattaccagcaggcagccctgaagtggaggaaggatattgggttccgggttaacgctaataccgccgcgctatccaacaaagtgctcgcagagtataaggtcccgggagaaatcgtgatgtctgtaaaagagatgctgagcgacatgatacgccgacgtaatcttatcctgaacagaggcggtgatgaaaatcccagggggcctgtttcccgggagcacgtggagtggtgtcgcgaatttgtcaagggaaaatacattatggccttcaacccaccctggggcgacatcaataagtcaggcagaagtgggattgctttggtggccacaggactcgcaaaactggctgagaccgaaggtaagggcgtgtttgatgaggccaagaaaactgtcgaagcgctgaacgggtatctcgacaagcataaagatgaggttgacaaggccagcgcagactctatgatcacaaacttactgaaacacatagctaaggcccaagagctttacaaaaattcctcagctttgagggcccagggagcacagattgataccgtgttcagcagttactattggctgtacaaagccggcgtaacgcctgacacttttccaaccgtgtctcagttcctattcgaactcggtaagcaaccccgggggacaaagaagatgaaaaaggctctgctttccactcctatgaagtggggcaaaaagctgtatgagttgtttgcggatgacagcttccagcagaaccgcatctacatgcatccagcagtcctcaccgccggacgaatttcggaaatgggcgtgtgctttgggacaatcccggttgctaatcccgatgacgccgcactgggatctggtcacaccaaatccatcttaaacctgagaacgaatactgagacaaacaatccttgtgccaagaccattgtgaaactcttcgaaatacagaagactggctttaacatccaagatatggacattgtcgcttcagagcatcttctgcaccagagtttggtggggaagcagagcccattccaaaatgcctataacgtaaaaggaaatgcaacatccgcgaacatcatatga

SEQ ID NO: 5979 - RNA, 1449 nt, synthetic construct
  misc_feature 1..1449: note = derived and/or modified CDS sequence (opt3) from CCHFV(CJH)__KU707899.1__N
  source 1..1449: mol_type = other RNA
atggagaacaagatcgaagtgaaaaataagcacgagaaaaacaagtggttcgaagagtttaaaaagggcaatgggctggtcgacaccttcacaaacagctactccttttgcgaaaatgttcccaacctcgatagattcgtgtttcagatggccggagctactgacgatgcacaaaaggactctatttatgcctcagcgcttgtagaggctacgaaattctgtgcccctatatacgagtgcgcatgggccagtagcaccggtatcgtgaagaaaggcctggaatggtttgagaagaatgctgggacaattaaatcctgggatgaatcttatactgagttgaaggtcgaggtgccaaagatcgaacagttatcgaactaccagcaggcagccctgaaatggaggaaggacattggattccggggcaatgctaacaccgccgcgctatcaaataaagttctcgcagagtataaggtgccgggtgaaatcgtcatgagcgtgaaagagatgctgagtgatatgatacgccgacgtaaccttatcctgaatagagggggagacgaaaaccccaggggccctgtatcccgggagcatgttgagtggtgtcgcgaatttgtgaagggcaaatacattatggccttcaatccaccctggggagatatcaacaagtctgggagaagcggtattgctttggtcgccacaggcctcgcaaagctggctgagaccgaagggaaaggagtgtttgacgaggccaagaaaactgtggaagcgctgaacggctatctcgataagcacaaagacgaggtcgataaggcctccgcagactcaatgatcacaaatttactgaagcatatagctaaagcccaagagctttacaagaacagtagcgctttgagggcccagggtgcacagattgacaccgttttctcttcctactattggctgtacaaagccggggtgacgcctgaaacttttccaaccgtatcacagttcctattcgagctcggaaagcaaccccggggcacaaagaagatgaagaaagctctgcttagcactcctatgaagtggggcaaaaagctgtatgaattgtttgcggatgacagtttccagcagaatcgcatctacatgcacccagcagtgctcaccgccgggcgaatttctgagatgggagtctgctttggtacaatcccggtggctaaccccgatgacgccgcactgggctccgggcataccaaaagcatcttaaatctgagaacgaacactgaaacaaataacccttgtgccaagaccattgttaaactcttcgagatacagaaaactggatttaatatccaagatatggacattgtggcttcggagcaccttctgcaccagtctttggtcggcaagcagtccccattccaaaacgcctataatgtgaaaggtaacgcaacatcagcgaatatcatatga

SEQ ID NO: 5980 - RNA, 1449 nt, synthetic construct
  misc_feature 1..1449: note = derived and/or modified CDS sequence (opt3) from CCHFV(CLT/TI05146)__DQ227496.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctgattaccagcaggcagccctgaagtggaggaaggacattgggttccgggtgaacgctaataccacagccctaagccacaaagtcctcgcggagtataaggtgccgggagaaatcgtaatgagtgttaaagagatgctgtccgatatgatacgccgacgtaaccttatcctgaatagaggcggtgacgaaaaccccagggggcctgtgtctcgggagcatgtcgagtggtgtcgcgaatttgtgaagggaaaatacattatggcattcaatccaccctggggcgatatcaacaagagcggcagatccgggattgccttggtggctaccggactcgccaaactggcagagactgaaggtaagggcgtctttgacgaggctaagaaaacagttgaagccctgaatgggtatctcaacaagcacaaagatgaggtggacaaggcgtcagccgacagtatgatcaccaacttactgaaacatatagcaaaggctcaagagctttacaagaatagctctgccttgagggctcagggagcccagattgatacggcattctcctcatactattggctgtacaaagccggcgtaactcctgaaacctttccaacagtgagccagttcctattcgagctcggtaagcaaccccgggggactaaaaagatgaaaaaggctctgcttagtacccctctgaagtggggcaaaaagttgtatgaactctttgcggacgattctttccagcagaaccgcatctacatgcacccagcagtcctgacagccggacgaatttccgagatgggcgtgtgctttgggaccatcccggttgctaatcccgacgatgccgcacagggaagcggtcatacgaaatcgatcttaaacctgagaactaatacagaaaccaacaatccttgtgccaagactattgtgaaactcttcgagatacaaaagacaggctttaacatccaggacatggatattgtcgcttctgagcaccttctgcaccagtccttggtggggaagcaatcaccattccagaatgcctataacgtaaaaggaaatgcaaccagtgcgaacatcatatga

SEQ ID NO: 5981 - RNA, 1449 nt, synthetic construct
  misc_feature 1..1449: note = derived and/or modified CDS sequence (opt3) from CCHFV(CYT/TI05099)__DQ227495.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctgattaccagcaggcagccctgaagtggaggaaggacattgggttccgggtgaacgctaataccacagccctaagccacaaagtcctcgcggagtataaggtgccgggagaaatcgtaatgagtgttaaagagatgctgtccgatatgatacgccgacgtaaccttatcctgaatagaggcggtgacgaaaaccccagggggcctgtgtctcgggagcatgtcgagtggtgtcgcgaatttgtgaagggaaaatacattatggcattcaatccaccctggggcgatatcaacaagagcggcagatccgggattgccttggtggctaccggactcgccaaactggcagagactgaaggtaagggcgtctttgacgaggctaagaaaacagttgaagccctgaatgggtatctcaacaagcacaaagatgaggtggacaaggcgtcagccgacagtatgatcaccaacttactgaaacatatagcaaaggctcaagagctttacaagaatagctctgccttgagggctcagggagcccagattgatacggcattctcctcatactattggctgtacaaagccggcgtaactcctgaaacctttccaacagtgagccagttcctattcgagctcggtaagcaaccccgggggactaaaaagatgaaaaaggctctgcttagtacccctctgaagtggggcaaaaagttgtatgaactctttgcggacgattctttccagcagaaccgcatctacatgcacccagcagtcctgacagccggacgaatttccgagatgggcgtgtgctttgggaccatcccggttgctaatcccgacgatgccgcacagggaagcggtcatacgaaatcgatccctaacttaagaactaatacagaaaccaacaatccatgtgccaagactattgtgaaactgttcgagatacaaaagacaggctttaacatccaggacatggatattgtcgcttctgagcacctccttcaccagtccctggtggggaagcaatcacccttccagaatgcctataacgtaaaaggaaatgcaaccagtgcgaacatcatatga

SEQ ID NO: 5982 - RNA, 1449 nt, synthetic construct
  misc_feature 1..1449: note = derived and/or modified CDS sequence (opt3) from CCHFV(Dubai 616)__JN108025.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccggagctactgatgacgcacaaaaagattcaatttatgccagtgcgcttgtagaggctacgaagttctgtgcccctatatacgagtgcgcatgggtgagctccaccggtatcgtcaagaaaggcctggaatggtttgagaagaatgccgggacaattaaatcttgggacgaatcgtatactgagttgaaggtggaggttccaaaaatcgaacagttagctaactaccagcaggcagccctgaagtggaggaaggatattggattccgggtgaatgctaacaccgccgcgctatcacacaaagtcctcgcagagtataaggtgccgggcgaaatcgtaatgagcgttaaagagatgctgagtgacatgatacgccgacgtaatcttatcctgaacagaggtggggatgaaaatcccaggggacctgtgtcccgggagcatgtcgagtggtgtcgcgaatttgtgaagggcaaatacattatggccttcaacccaccctggggcgacatcaataagtctgggagaagcggaattgctttggtggccacaggtctcgcaaaactggctgagaccgaaggcaagggggtctttgatgaggccaagaaaactgttgaagcgctgaacggatatctcgacaagcacaaagatgaggtggacaaggcctccgcagacaacatgatcacaaatttactgaaacatatagctaaggcccaagagctttacaagaactcaagtgctttgagggcccagggcgcacagattgataccgccttcagctcttactattggctgtacaaagctggtgtaacgcctgaaacttttccaaccgtgtcccagttcctattcgagctcgggaagcaaccccggggaactaaaaagatgaaaaaggcgctgctttcaacacctatgaagtggggcaaaaagctgtatgaattgtttgcagacgatagcttccagcagaatcgcatctacatgcacccagccgtcctcaccgctggccgaattagtgagatgggggtgtgctttggaacaatcccggttgccaaccccgacgatgcagcccagggttctggccataccaaatccatcctgaatttaagaacgaacactgaaacaaataacccttgtgctaagaccattgtgaaactgttcgagatacaaaagactgggtttaatatccaggacatggatattgtcgccagcgagcacctccttcaccagtcgctggtgggaaagcaatctccattccagaacgcatataatgtaaaaggcaacgcgacatccgctaatatcatatga

SEQ ID NO: 5983 - RNA, 1449 nt, synthetic construct
  misc_feature 1..1449: note = derived and/or modified CDS sequence (opt3) from CCHFV(GRH)__KU707900.1__N
  source 1..1449: mol_type = other RNA
atggagaacaagatcgaagtgaatagcaaagacgagatgaacaagtggttcgaagagtttaaaaagggcaatgggctggtcgataccttcacaaactcctactctttttgcgaatcagttcccaatctcgacagattcgtgtttcagatggccagtgctactgatgacgcacaaaaagatagcatttatgcctccgcgcttgtagaggctacgaagttctgtgcccctatatacgagtgcgcatgggcctcttcgaccggaatcgtgaagaaaggtctggaatggtttgagaagaacgctggcacaattaaatcatgggacgaaagctatactgagttgaaggtcgaggtgccaaaaatcgaacagttaagtaattaccagcaggcagccctgaagtggaggaaggatattgggttccgggttaacgctaataccgccgcgctatccaacaaagtgctcgcagagtataaggtcccgggagaaatcgtgatgtctgtaaaagagatgctgagcgacatgatacgccgacgtaatcttatcctgaacagaggcggtgatgaaaatcccagggggcctgtttcccgggagcacgtggagtggtgtcgcgaatttgtcaagggaatgtacattatggccttcaacccaccctggggcgacatcaataaatcaggcagaagtgggattgctttggtggccacaggactcgcaaagctggctgagaccgaaggtaaaggcgtgtttgatgaggccaagaagactgtcgaagcgctgaacgggtatctcgacaaacataaggatgaggttgacaaagccagcgcagactctatgatcacaaacttactgaagcacatagctaaagcccaagagctttacaaaaattcctcagctttgagggcccagggagcacagattgataccgtgttcagcagttactattggctgtacaaggccggcgtaacgcctgacacttttccaaccgtgtctcagttcctattcgaactcggtaagcaaccccgggggacaaagaaaatgaagaaagctctgctttccactcctatgaagtggggaaagaaactgtatgagttgtttgcggatgacagcttccagcagaaccgcatctacatgcatccagcagtcctcaccgccggccgaatttcggaaatgggcgtgtgctttgggacaatcccggttgctaatcccgatgacgccgcactgggatctggtcacaccaagtccatcttaaacctgagaacgaatactgagacaaacaatccttgtgccaaaaccattgtgaaactcttcgaaatacagaagactggctttaacatccaagatatggacattgtcgcttcagagcatcttctgcaccagagtttggtggggaagcagagcccattccaaaatgcctataacgtaaagggaaatgcaacatccgcgaacatcatatga

SEQ ID NO: 5984 - RNA, 1449 nt, synthetic construct
  misc_feature 1..1449: note = derived and/or modified CDS sequence (opt3) from CCHFV(Iran-Gilan69)__KJ027521.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcacaattaagtcatgggacgaaaactatgccgagttgaaagtcgatgtgccaaagatcgagcagttagctagctaccagcaggcagccctgaagtggagaaaagacattgggttcagggttaatgctaacactgccgcgctaagtaataaggtgctcgcagaatataaagtcccgggagagatcgtgatgtccgtaaaggaaatgctgtctgatatgatacggcgccgaaaccttatcctgaatcgtggcggtgacgagaaccccagagggcctgttagcagggaacacgtggagtggtgtcgggagtttgtcaaaggaaagtacattatggccttcaatccaccctggggcgatatcaacaaatccggccgctcagggattgctttggtggccaccggactcgcaaagctggctgaaacagagggtaagggcgtgtttgacgaagccaaaaagaccgtcgaggcgctgaacgggtatctcgataaacatagagacgaagttgacaaggccagtgcagatagcatgatcactaatttactgaaacacatagctaaggcccaagagctttacaagaactcttccgctttgagggcccagggagcacagattgacacacctttcagctcattttactggctgtataaagccggcgtgaccccagagacgttccccactatcagtcagttcctatttgaactcggtaagcaacctcgggggaccaaaaagatgaaaaaggctctgctttctacaccaatgaagtggggcaaaaagctgtacgagttgttcgcggatgactcctttcagcagaatcgcatttatatgcatccggcagtactcactgccggacgaatcagcgaaatgggcgtgtgcttcgggaccatccccgtcgctaaccctgatgacgccgcacagggatcgggtcacacaaaatctattctgaatttaagaacctccacggagactaacaatccatgtgccaagacaatagtgaaactgtttgaaatccaaaagaccggcttcaacattcaggatatggacatcgttgcttcagagcatctccttcaccagagtctggtggggaagcaaagcccctttcagaatgcctacaacgtcaaaggaaatgcaacttccgcgaacataatttga

SEQ ID NO: 5985 - RNA, 1449 nt, synthetic construct
  misc_feature 1..1449: note = derived and/or modified CDS sequence (opt3) from CCHFV(Iran-Isfahan78)__KJ027522.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcacaattaagtcatgggacgaaaactatgccgagttgaaagtcgatgtgccaaagatcgagcagttagctaattaccagcaggcagccctgaagtggagaaaagacattgggttcagggttaacgctaatactgccgcgctaagcaacaaggtgctcgcagaatataaagtcccgggagagatcgtgatgagtgtaaaggaaatgctgtccgatatgatacggcgccgaaatcttatcctgaaccgtggcggtgacgagaatcccagagggcctgtttctagggaacacgtggagtggtgtcgggagtttgtcaaaggaaagtacattatggccttcaacccaccctggggcgatatcaacaaaagcggccgctccgggattgctttggtggccaccggactcgcaaagctggctgaaacagagggtaagggcgtgtttgacgaagccaaaaagaccgtcgaggcgctgaatgggtatctcgataaacatagagacgaagttgacaaggcctcagcagatagtatgatcactaacttactgaaacacatagctaaggcccaagagctttacaagaatagctctgctttgagggcccagggagcacagattgacacacctttctcctcattttactggctgtataaagccggcgtgaccccagagacgttccccactgtaagccagttcctatttgaactcggtaagcaacctcgggggaccaaaaagatgaaaaaggctctgcttagtacaccaatgaagtggggcaaaaagctgtacgagttgttcgcggatgactcttttcagcagaaccgcatctatatgcatccggcagtgctcactgccggacgaatttccgaaatgggcgtctgcttcgggaccatccccgtggctaatcctgatgacgccgcacagggaagcggtcacacaaaatcgatcctgaacttaagaacctctacggagactaataacccatgtgccaagacaattgttaaactgtttgaaatacaaaagaccggcttcaatatccaggatatggacattgtggcttccgagcatctccttcaccagtcactggtcgggaagcaaagtccctttcagaacgcctacaatgtgaaaggaaacgcaactagcgcgaatatcatatga

SEQ ID NO: 5986 - RNA, 1449 nt, synthetic construct
  misc_feature 1..1449: note = derived and/or modified CDS sequence (opt3) from CCHFV(Iran-KhRazavi72)__KJ485700.1__N
  source 1..1449: mol_type = other RNA
atggagaacaagatcgaagtgaaaaataagcacgagaaaaacaagtggttcgaagagtttaaaaagggcaatgggctggtcgacaccttccccaacagctactccttttgcgaaaatgttcctaacctcgatagattcgtgtttcagatggccggagctacagacgatgcacaaaaggactctatttatgcctcagcgcttgtagaggctactaaattctgtgccccaatatacgagtgcgcatgggccagtagcacgggtatcgtgaagaaaggcctggaatggtttgagaagaatgctgggaccattaaatcctgggatgaatcttatacagagttgaaggtcgaggtgccgaagatcgaacagttatcgaactaccagcaggcagccctgaaatggaggaaggacattggattccggggcaatgctaacactgccgcgctatcaaataaagttctcgcagagtataaggtgcccggtgaaatcgtcatgagcgtgaaagagatgctgagtgatatgatacgccgacgtaaccttatcctgaatagagggggagacgaaaaccctaggggcccagtatcccgggagcatgttgagtggtgtcgcgaatttattaagggcaaatacatcatggccttcaatcccccttggggagatattaacaagtctgggagaagcggtatcgctttggtggccaccggcctcgcaaagctggctgagacagaagggaaaggagtctttgacgaggccaagaaaaccgtggaagcgctgaacggctatctcgataagcacaaagacgaggtggataaggcctccgcagactcaatgataactaatttactgaagcatattgctaaagcccaagagctttacaagaacagtagcgctttgagggcccagggtgcacagatcgacacagtcttctcttcctactattggctgtacaaagccggggttaccccagaaacgtttcccactgtgtcacagttcctattcgagctcggaaagcaacctcggggcaccaaaaagatgaagaaagctctgcttagcacaccaatgaagtggggcaaaaagctgtatgaattgtttgcggatgacagtttccagcagaatcgcatttacatgcacccggcagtactcactgccgggcgaatctctgagatgggagtgtgctttggtaccatccccgtcgctaaccctgatgacgccgcactgggctccgggcatacaaaaagcattttaaatctgagaaccaacacggaaactaataacccatgtgccaagacaatagtgaaactcttcgagatccagaagaccggatttaatattcaagatatggacatcgttgcttcggagcaccttctgcaccagtctttggtgggcaagcagtcccccttccaaaacgcctataatgtcaaaggtaacgcaacttcagcgaatataatttga

SEQ ID NO: 5987 - RNA, 1449 nt, synthetic construct
  misc_feature 1..1449: note = derived and/or modified CDS sequence (opt3) from CCHFV(Iran-Zahedan19)__KJ676542.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccggagctactgatgacgcacaaaaagattcaatttatgccagtgcgcttgtagaggctacgaagttctgtgcccctatatacgagtgcgcatgggtgagctccaccggtatcgtcaagaaaggcctggaatggtttgagaagaatgccgggacaattaaatcttgggacgaatcgtatactgagttgaaggtggaggttccaaaaatcgaacagttagctaactaccagcaggcagccctgaagtggaggaaggatattggattccgggtgaatgctaacaccgccgcgctatcacacaaagtcctcgcagagtataaggtgccgggcgaaatcgtaatgagcgttaaagagatgctgagtgacatgatacgccgacgtaatcttatcctgaacagaggtggggatgaaaatcccaggggacctgtgtcccgggagcatgtcgagtggtgtcgcgaatttgtgaagggcaaatacattatggccttcaacccaccctggggcgacatcaataagtctgggagaagcggaattgctttgatcgccacaggtctcgcaaaactggctgagaccgaaggcaagggggtgtttgatgaggccaagaaaactgtcgaagcgctgaacggatatctcgacaagcacaaagatgaggttgacaaggcctccgcagacaacatgataacaaatttactgaaacatattgctaaggcccaagagctttacaagaactcaagtgctttgagggcccagggcgcacagatcgataccgccttcagctcttactattggctgtacaaagctggtgtgacgcctgaaacttttccaaccgtatcccagttcctattcgagctcgggaagcaaccccggggaactaaaaagatgaaaaaggcgctgctttcaacacctatgcgctggggcaagaaactgtatgaattgtttgcagacgatagcttccagcagaatcgaatttacatgcacccagccgtgctcaccgctggcagaatcagtgagatgggggtctgctttggaacaatcccggtggccaaccccgacgatgcagcccagggttctggccataccaagtccattctgaatttaaggacgaacactgaaacaaataacccttgtgctaaaaccatagttaagctgttcgagatccagaaaactgggtttaatattcaagacatggatatcgtggccagcgagcacctccttcaccagtcgctggtcggaaagcaatctccattccagaacgcatataatgtgaagggcaacgcgacatccgctaatataatttga

SEQ ID NO: 5988 - RNA, 1449 nt, synthetic construct
  misc_feature 1..1449: note = derived and/or modified CDS sequence (opt3) from CCHFV(NIV 112143)__JN572089.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctaactaccagcaggcagccctgaagtggaggaaggatattgggttccgggtgaatgctaacaccgccgcgctaagccacaaagtcctcgcagagtataaggtgccgggagaaatcgtaatgagtgttaaagagatgctgtccgacatgatacgccgacgtaatcttatcctgaacagaggcggtgatgaaaatcccagggggcctgtgtctcgggagcatgtcgagtggtgtcgcgaatttgtgaagggaaaatacattatggccttcaacccaccctggggcgacatcaataagagcggcagatccgggattgctttgatcgccacaggactcgcaaaactggctgagaccgaaggtaagggcgtgtttgatgaggccaagaaaactgtcgaagcgctgaacgggtatctcgacaagcacaaagatgaggttgacaaggcctcagcagacaacatgataacaaatttactgaaacatattgctaaggcccaagagctttacaagaacagtagcgctttgagggcccagggagcacagatcgataccgccttctcttcctactattggctgtacaaagctggcgtgacgcctgaaacttttccaaccgtatcacagttcctattcgagctcggtaagcaaccccgggggactaaaaagatgaaaaaggcgctgcttagcacacctatgcgctggggaaagaaactgtatgaattgtttgcagacgatagtttccagcagaatcgaatttacatgcacccagccgtgctcaccgctggcagaatctctgagatgggcgtctgctttgggacaatcccggtggccaaccccgacgatgcagcccagggatccggtcataccaagagcattctgaatttaaggacgaacactgaaacaaataacccttgtgctaaaaccatagttaagctgttcgagatccagaaaactggctttaatattcaagacatggatatcgtggcctcggagcacctccttcaccagtctctggtcgggaagcaatccccattccagaacgcatataatgtgaagggaaacgcgacatcagctaatataatttga

SEQ ID NO: 5989 - RNA, 1449 nt, synthetic construct
  misc_feature 1..1449: note = derived and/or modified CDS sequence (opt3) from CCHFV(NIVA 118595)__JN572088.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctaactaccagcaggcagccctgaagtggaggaaggatattgggttccgggtgaatgctaacaccgccgcgctaagccacaaagtcctcgcagagtataaggtgccgggagaaatcgtaatgagtgttaaagagatgctgtccgacatgatacgccgacgtaatcttatcctgaacagaggcggtgatgaaaatcccagggggcctgtgtctcgggagcatgtcgagtggtgtcgcgaatttgtgaagggaaaatacattatggccttcaacccaccctggggcgacatcaataagagcggcagatccgggattgctttggtggccacaggactcgcaaaactggctgagaccgaaggtaagggcgtctttgatgaggccaagaaaactgttgaagcgctgaacgggtatctcgacaagcacaaagatgaggtggacaaggcctcagcagacaacatgatcacaaatttactgaaacatatagctaaggcccaagagctttacaagaacagtagcgctttgagggcccagggagcacagattgataccgccttctcttcctactattggctgtacaaagctggcgtaacgcctgaaacttttccaaccgtgtcacagttcctattcgagctcggtaagcaaccccgggggactaaaaagatgaaaaaggcgctgcttagcacacctatgcgctggggaaagaaactgtatgaattgtttgcagacgatagtttccagcagaatcgaatctacatgcacccagccgtcctcaccgctggcagaatttctgagatgggcgtgtgctttgggacaatcccggttgccaaccccgacgatgcagcccagggatccggtcataccaagagcatcctgaatttaaggacgaacactgaaacaaataacccttgtgctaaaaccattgtgaagctgttcgagatacagaaaactggctttaatatccaagacatggatattgtcgcctcggagcacctccttcaccagtctctggtggggaagcaatccccattccagaacgcatataatgtaaagggaaacgcgacatcagctaatatcatatga

SEQ ID NO: 5990 - RNA, 1449 nt, synthetic construct
  misc_feature 1..1449: note = derived and/or modified CDS sequence (opt3) from CCHFV(SPU 130/89)__KJ682821.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggcctcagctactgatgacgcacaaaaggatagtatttatgccagcgcgcttgtagaggctacgaagttctgtgcccctatatacgagtgcgcatgggtgtcctctaccggaatcgtcaaaagaggtctggaatggtttgagaagaatgccggcacaattaaatcgtgggacgaatcatatactgagttgaaggtggatgttccaaaaatcgagcagttagctaactaccagcaggcagccctgaagtggaggaaggacattgggttccgggtgaatgctaacaccgccgcgctaagcaataaagtcctcgcagaatataaggtgccgggagagatcgtaatgagtgttaaagaaatgctgtccgatatgatacgccgacgtaaccaaatccttaatagaggcggtgacgagaaccccagggggcctgtgtctcgggaacacgtcgattggtgtcgcgagtttgtgaagggaaaatacattatggccttcaatccaccctggggcgacatcaacaagagcggcagatccgggattgctctggtggccacaggattggcaaaactcgctgagaccgaaggtaagggcgtctttgatgaggccaagaaaactgttgaagcgctgaacgggtatctggacaagcataaagacgaggtggatagggcctcagcagacagtatgatcacaaatctcttaaagcacatagctaaagcccaggaactgtacaagaacagctctgcccttcgggctcagggagcacagattgataccgccttctcctcatactattggttgtacaaggctggcgtaacgcctgagacttttccaaccgtgagccaattcctgttcgagctaggtaaacagccccgcgggacaaagaaaatgaagaaagcgctcctgagtactcctatgaagtggggaaagaaactttatgaactgtttgcagacgattctttccagcagaatcgaatctacatgcatccagccgtcttgaccgctggcagaatttccgagatgggcgtgtgctttgggacaatcccggttgccaaccccgacgatgcagcccaaggaagcggtcacaccaagtcgatcctcaatctgaggacgaacactgaaacaaataacccttgtgctcggaccattgtgaaattattcgagatacagaagactggctttaatatccaggacatggatattgtcgcctctgaacatctgctccaccaatcccttgtggggaaacagtcaccattccagaacgcatataatgtaaagggaaacgcgacaagtgctaatatcgtttga

SEQ ID NO: 5991 - RNA, 1449 nt, synthetic construct
  misc_feature 1..1449: note = derived and/or modified CDS sequence (opt3) from CCHFV(SPU 18/88)__KJ682818.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggcctcagctactgatgacgcacaaaaggatagtatttatgccagcgcgcttgtagaggctacgaagttctgtgcccctatatacgagtgcgcatgggtgtcctctaccggaatcgtcaaaagaggtctggaatggtttgagaagaatgccggcacaattaaatcgtgggacgaatcatatactgagttgaaggtggatgttccaaaaatcgagcagttagctaactaccagcaggcagccctgaagtggaggaaggacattgggttccgggtgaatgctaacaccgccgcgctaagcaataaagtcctcgcagaatataaggtgccgggagagatcgtaatgagtgttaaagaaatgctgtccgatatgatacgccgacgtaaccaaatccttaatagaggcggtgacgagaaccccagggggcctgtgtctcgggaacacgtcgattggtgtcgcgagtttgtgaagggaaaatacattatggccttcaatccaccctggggcgacatcaacaagagcggcagatccgggattgctctggtggccacaggattggcaaaactcgctgagaccgaaggtaagggcgtctttgatgaggccaagaaaactgttgaagcgctgaacgggtatctggacaagcataaagacgaggtggatagggcctcagcagacagtatggtaacaaatctcttaaagcacatcgctaaagcccaggaactgtacaagaacagctctgcccttcgggctcagggagcacagatagataccgccttctcctcatactattggttgtacaaggctggcgtgacgcctgagacttttccaaccgtcagccaattcctgttcgagctaggtaaacagccccgcgggacaaagaaaatgaagaaagcgctcctgagtactcctatgaagtggggaaagaaactttatgaactgtttgcagacgattctttccagcagaatcgaatttacatgcatccagccgtgttgaccgctggcagaatctccgagatgggcgtttgctttgggacaattccggtggccaaccccgacgatgcagcccaaggaagcggtcacaccaagtcgatcctcaatctgaggacgaacactgaaacaaataacccttgtgctcggaccatcgtcaaattattcgagattcagaagactggctttaatatacaggacatggatatcgtggcctctgaacatctgctccaccaatcccttgtagggaaacagtcaccattccagaacgcatataatgttaagggaaacgcgacaagtgctaatattatctga

SEQ ID NO: 5992 - RNA, 1449 nt, synthetic construct
  misc_feature 1..1449: note = derived and/or modified CDS sequence (opt3) from CCHFV(SPU 187/90)__KJ682823.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggcctcagctactgatgacgcacaaaaggatagtatttatgccagcgcgcttgtagaggctacgaagttctgtgcccctatatacgagtgcgcatgggtgtcctctaccggaatcgtcaaaagaggtctggaatggtttgagaagaatgccggcacaattaaatcgtgggacgaatcatatactgagttgaaggtggatgttccaaaaatcgagcagttagctaactaccagcaggcagccctgaagtggaggaaggacattgggttccgggtgaatgctaacaccgccgcgctaagcaataaagtcctcgcagaatataaggtgccgggagagatcgtaatgagtgttaaagaaatgctgtccgatatgatacgccgacgtaaccaaatccttaatagaggcggtgacgagaaccccagggggcctgtgtctcgggaacacgtcgattggtgtcgcgagtttgtgaagggaaaatacattatggccttcaatccaccctggggcgacatcaacaagagcggcagatccgggattgctctggtggccacaggattggcaaaactcgctgagaccgaaggtaagggcgtctttgatgaggccaagaaaactgttgaagcgctgaacgggtatctggacaagcataaagacgaggtggatagggcctcagcagacagtatgatcacaaatctcttaaagcacatagctaaagcccaggaactgtacaagaacagctctgcccttcgggctcagggagcacagattgataccgccttctcctcatactattggttgtacaaggctggcgtaacgcctgagacttttccaaccgtgagccaattcctgttcgagctaggtaaacagccccgcgggacaaagaaaatgaagaaagcgctcctgagtactcctatgaagtggggaaagaaactttatgaactgtttgcagacgattctttccagcagaatcgaatctacatgcatccagccgtcttgaccgctggcagaatttccgagatgggcgtgtgctttgggacaatcccggttgccaaccccgacgatgcagcccaaggaagcggtcacaccaagtcgatcctcaatctgcagacgaacactgaaacaaataacccttgtgctaggaccattgtgaaattattcgagatacagaagactggctttaatatccaagacatggatattgtcgcctctgaacatctgctccaccagtcccttgtggggaaacagtcaccattccagaacgcatataatgtaaagggaaacgcgacaagtgctaatatcatatga

SEQ ID NO: 5993 - RNA, 1449 nt, synthetic construct
  misc_feature 1..1449: note = derived and/or modified CDS sequence (opt3) from CCHFV(SPU 383/87)__KJ682816.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccggagctactgatgacgcacaaaaggattcaatttatgccagtgcgcttgtagaggctacgaagttctgtgcccctatatacgagtgcgcatgggtgagctccaccggtatcgtcaaaagaggcctggaatggtttgagaagaatgccgggacaattaaatcttgggacgaatcgtatactgagttgaaggtggatgttccaaaaatcgagcagttagctaactaccagcaggcagccctgaagtggaggaaggacattggattccgggtgaatgctaacaccgccgcgctatcaaataaagtcctcgcagaatataaggtgccgggcgagatcgtaatgagcgttaaagaaatgctgagtgatatgatacgccgacgtaaccaaatccttaatagaggtggggacgagaaccccaggggacctgtgtcccgggaacacgtcgattggtgtcgcgagtttgtgaagggcaaatacattatggccttcaatccaccctggggcgacatcaacaagtctgggagaagcggaattgctctggtggccacaggtttggcaaaactcgctgagaccgaaggcaagggggtctttgatgaggccaagaaaactgttgaagcgctgaacggatatctggacaagcataaagacgaggtggatagggcctccgcagactcaatgatcacaaatctcttaaagcacatagctaaagcccaggaactgtacaagaacagtagcgcccttcgggctcagggcgcacagattgataccgccttctcttcctactattggttgtacaaggctggtgtaacgcctgagacttttccaaccgtgtcacaattcctgttcgagctagggaaacagccccgcggaacaaagaaaatgaagaaagcgctcctgagcactcctatgaagtggggcaagaaactttatgaactgtttgcagacgatagtttccagcagaatcgaatctacatgcatccagccgtcttgaccgctggcagaatttctgagatgggggtgtgctttggaacaatcccggttgccaaccccgacgatgcagcccaaggttccggccacaccaagagcatcctcaatctgaggacgaacactgaaacatcgaatccttgtgctcggaccattgtgaaattattcgagatacagaagactgggtttaacatccaggacatggatattgtcgcctctgaacatctgctccaccaatcccttgtgggaaaacagtcaccattccagaatgcatataacgtaaagggcaatgcgacaagtgctaacatcgtttga

SEQ ID NO: 5994 - RNA, 1449 nt, synthetic construct
  misc_feature 1..1449: note = derived and/or modified CDS sequence (opt3) from CCHFV(SPU 383/87)__KJ682816.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccggagctactgatgacgcacaaaaggattcaatttatgccagtgcgcttgtagaggctacgaagttctgtgcccctatatacgagtgcgcatgggtgagctccaccggtatcgtcaaaagaggcctggaatggtttgagaagaatgccgggacaattaaatcttgggacgaatcgtatactgagttgaaggtggatgttccaaaaatcgagcagttagctaactaccagcaggcagccctgaagtggaggaaggacattggattccgggtgaatgctaacaccgccgcgctatcaaataaagtcctcgcagaatataaggtgccgggcgagatcgtaatgagcgttaaagaaatgctgagtgatatgatacgccgacgtaaccaaatccttaatagaggtggggacgagaaccccaggggacctgtgtcccgggaacacgtcgattggtgtcgcgagtttgtgaagggcaaatacattatggccttcaatccaccctggggcgacatcaacaagtctgggagaagcggaattgctctggtggccacaggtttggcaaaactcgctgagaccgaaggcaagggggtctttgatgaggccaagaaaactgttgaagcgctgaacggatatctggacaagcataaagacgaggtggatagggcctccgcagactcaatgatcacaaatctcttaaagcacatagctaaagcccaggaactgtacaagaacagtagcgcccttcgggctcagggcgcacagattgataccgccttctcttcctactattggttgtacaaggctggtgtaacgcctgagacttttccaaccgtgtcacaattcctgttcgagctagggaaacagccccgcggaacaaagaaaatgaagaaagcgctcctgagcactcctatgaagtggggcaagaaactttatgaactgtttgcagacgatagtttccagcagaatcgaatctacatgcatccagccgtcttgaccgctggcagaatttctgagatgggggtgtgctttggaacaatcccggttgccaaccccgacgatgcagcccaaggttccggccacaccaagagcatcctcaatctgaggacgaacactgaaacatcgaatccttgtgctcggaccattgtgaaattattcgagatacagaagactgggtttaacatccaggacatggatattgtcgcctctgaacatctgctccaccaatcccttgtgggaaaacagtcaccattccagaatgcatataacgtaaagggcaatgcgacaagtgctaacatcatatga

SEQ ID NO: 5995 - RNA, 1449 nt, synthetic construct
  misc_feature 1..1449: note = derived and/or modified CDS sequence (opt3) from CCHFV(SPU 431/85)__KJ682815.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggcctcagctactgatgacgcacaaaaggatagtatttatgccagcgcgcttgtagaggctacgaagttctgtgcccctgtgtacgagtgcgcatgggtctcctctaccggaatagtgaaaagaggtctggaatggtttgagaagaatgccggcacaatcaaatcgtgggacgaatcatatactgagttgaaggttgatgtgccaaaaattgagcagttagctaactaccagcaggcagccctgaagtggaggaaggacatcgggttccgggtcaatgctaacaccgccgcgctaagcaataaagtgctcgcagaatataaggtaccgggagagattgttatgagtgtgaaagaaatgctgtccgatatgatccgccgacgtaaccaaatacttaatagaggcggtgacgagaaccccagggggcctgtctctcgggaacacgtggattggtgtcgcgagtttgtgaagggaaaatacatcatggccttcaatccaccctggggcgacattaacaagagcggcagatccgggatcgctctggtcgccacaggattggcaaaactcgctgagaccgaaggtaagggcgtttttgatgaggccaagaaaactgtggaagcgctgaacgggtatctggacaagcataaagacgaggtagatagggcctcagcagacagtatgattacaaatctcttaaagcacatcgctaaagcccaggaactgtacaagaacagctctgcccttcgggctcagggagcacagatagataccgccttctcctcatactattggttgtacaaggctggcgtgacgcctgagacttttccaaccgtcagccaattcctgttcgagctaggtaaacagccccgcgggacaaagaaaatgaagaaagcgctcctgagtactcctatgaagtggggaaagaaactttatgaactgtttgcagacgataccttccagcagaatcgaatttacatgcatccagccgtgttgacagctggcagaatctctgagatgggcgtttgctttgggaccattccggtggccaaccccgacgatgcagcccaaggatccggtcacactaagagcatcctcaatctgaggacgaacacagaaaccaataacccttgtgctcggactatcgtcaaattattcgagattcagaagacaggctttaatatacaggacatggatatcgtggcctcggaacatctgctccaccaatctcttgtagggaaacagtccccattccagaacgcatataatgttaagggaaacgcgacctcagtgaatattatctga

SEQ ID NO: 5996 - RNA, 1449 nt, synthetic construct
  misc_feature 1..1449: note = derived and/or modified CDS sequence (opt3) from CCHFV(SPU 45/88)__KJ682819.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggcctcagctactgatgacgcacaaaaggatagtatttatgccagcgcgcttgtagaggctacgaagttctgtgcccctatatacgagtgcgcatgggtgtcctctaccggaatcgtcaaaagaggtctggaatggtttgagaagaatgccggcacaattaaatcgtgggacgaatcatatactgagttgaaggtggatgttccaaaaatcgagcagttagctaactaccagcaggcagccctgaagtggaggaaggacattgggttccgggtgaatgctaacaccgccgcgctaagcaataaagtcctcgcagaatataaggtgccgggagagatcgtaatgagtgttaaagaaatgctgtccgatatgatacgccgacgtaaccaaatccttaatagaggcggtgacgagaaccccagggggcctgtgtctcgggaacacgtcgattggtgtcgcgagtttgtgaagggaaaatacattatggccttcaatccaccctggggcgacatcaacaagagcggcagatccgggattgctctggtggccacaggattggcaaaactcgctgagaccgaaggtaagggcgtctttgatgaggccaagaaaactgttgaagcgctgaacgggtatctggacaagcataaagacgaggtggatagggcctcagcagacagtatgatcacaaatctcttaaagcacatagctaaagcccaggaactgtacaagaacagctctgcccttcgggctcagggagcacagattgataccgccttctcctcatactattggttgtacaaggctggcgtaacgcctgagacttttccaaccgtgagccaattcctgttcgagctaggtaaacagccccgcgggacaaagaaaatgaagaaagcgctcctgagtactcctatgaagtggggaaagaaactttatgaactgtttgcagacgattctttccagcagaatcgaatctacatgcatccagccgtcttgaccgctggcagaatttccgagatgggcgtgtgctttgggacaatcccggttgccaaccccgacgatgcagcccaaggaagcggtcacaccaagtcgatcctcaatctgaggacgaacactgaaacaaataacccttgtgctcggaccattgtgaaattattcgagatacagaagactggctttaatatccaggacatggatattgtcgcctctgaacatctgctccaccaatcccttgtggggaaacagtcaccattccagaacgcatataatgtaaagggaaacgcgacaagtgctaatatcatatga

SEQ ID NO: 5997 - RNA, 1449 nt, synthetic construct
  misc_feature 1..1449: note = derived and/or modified CDS sequence (opt3) from CCHFV(SPU 48/90)__KJ682822.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggcctcagctactgatgacgcacaaaaggatagtatttatgccagcgcgcttgtagaggctacgaagttctgtgcccctatatacgagtgcgcatgggtgtcctctaccggaatcgtcaaaagaggtctggaatggtttgagaagaatgccggcacaattaaatcgtgggacgaatcatatactgagttgaaggtggatgttccaaaaatcgagcagttagctaactaccagcaggcagccctgaagtggaggaaggacattgggttccgggtgaatgctaacaccgccgcgctaagcaataaagtcctcgcagaatataaggtgccgggagagatcgtaatgagtgttaaagaaatgctgtccgatatgatacgccgacgtaaccaaatccttaatagaggcggtgacgagaaccccagggggcctgtgtctcgggaacacgtcgattggtgtcgcgagtttgtgaagggaaaatacattatggccttcaatccaccctggggcgacatcaacaagagcggcagatccgggattgctctggtggccacaggattggcaaaactcgctgagaccgaaggtaagggcgtctttgatgaggccaagaaaactgttgaagcgctgaacgggtatctggacaagcataaagacgaggtggatagggcctcagcagacagtatgatcacaaatctcttcaagcacatagctaaagcccaggaattatacaagaacagctctgctctgcgggcccagggagcacagattgataccgccttttcctcatactattggctttacaaggctggcgtaacgcctgagactttcccaaccgtgagccaattcttgtttgagctgggtaaacagccccgcgggacaaagaaaatgaagaaagcgctactcagtactcctatgaagtggggaaagaaactgtatgaacttttcgcagacgattcttttcagcagaatcgaatctacatgcatccagccgtcctgaccgctggcagaatttccgagatgggcgtgtgcttcgggacaatcccggttgccaaccccgacgatgcagcccaaggaagcggtcacaccaagtcgatcttgaatctcaggacgaacactgaaacaaataacccttgtgctcggaccattgtgaaactgtttgagatacagaagactggcttctctatccaggacatggatattgtcgcctccgaacatttactgcaccaatcactcgtggggaaacagagtccatttcagaatgcatataacgtaaagggaaatgcgacaagcgctaacatcatatga

SEQ ID NO: 5998 - RNA, 1449 nt, synthetic construct
  misc_feature 1..1449: note = derived and/or modified CDS sequence (opt3) from CCHFV(SPU 497/88)__KJ682820.1__N
  source 1..1449: mol_type = other RNA
atggagaacaagatcgaagtgaataacaaagacgagatgaataagtggttcgaagagtttaaaaagggcaacgggctggtcgatactttcacaaatagctactccttttgcgaatctgttcccaacctcgacaaattcgtgtttcagatggcctcagctactgatgacgcacaaaaggatagtatttatgccagcgcgcttgtagaggctacgaagttctgtgcccctatatacgagtgcgcatgggtgtcctctaccggaatcgtcaaaagaggtctggaatggtttgagaagaatgccggcacaattaaatcgtgggacgaatcatatactgagttgaaggtggatgttccaaaaatcgagcagttagctaactaccagcaggcagccctgaagtggaggaaggacattgggttccgggtgaatgctaacaccgccgcgctaagcaataaagtcctcgcagaatataaggtgccgggagagatcgtaatgagtgttaaagaaatgctgtccgatatgatacgccgacgtaaccaaatccttaatagaggcggtgacgagaaccccagggggcctgtgtctcgggaacacgtcgattggtgtcgcgagtttgtgaagggaaaatacattatggccttcaatccaccctggggcgacatcaacaagagcggcagatccgggattgctctggtggccacaggattggcaaaactcgctgagaccgaaggtaagggcgtctttgatgaggccaagaaaactgttgaagcgctgaacgggtatctggacaagcataaagacgaggtggatagggcctcagcagacagtatgatcacaaatctcttaaagcacatagctaaagcccaggaactgtacaagaacagctctgcccttcgggctcagggagcacagattgataccgccttctcctcatactattggttgtacaaggctggcgtaacgcctgagacttttccaaccgtgagccaattcctgttcgagctaggtaaacagccccgcgggacaaagaaaatgaagaaagcgctcctgagtactcctatgaagtggggaaagaaactttatgaactgtttgcagacgattctttccagcagaatcgaatctacatgcatccagccgtcttgaccgctggcagaatttccgagatgggcgtgtgctttggggccatcccggttgcaaaccccgacgatgccgctcaaggaagcggtcacacaaagtcgatcctcaatctgaggaccaacacggaaactaataacccttgtgcccggacaattgtgaaattattcgagatacagaagaccggctttaatatccaggacatggatattgtcgcatctgaacatctgctccaccaatcccttgtggggaaacagtcaccattccagaacgcgtataatgtaaagggaaacgctaccagtgccaatatcatatga

SEQ ID NO: 5999 - RNA, 1449 nt, synthetic construct
  misc_feature 1..1449: note = derived and/or modified CDS sequence (opt3) from CCHFV(SPU 556/87)__KJ682817.1__N
  source 1..1449: mol_type = other RNA
atggagaacaagatcgaagtgaataacaaagacgagatgaatagatggttcgaagagtttaagaaaggcaacgggctggtcgataccttcacaaatagctactccttttgcgaatctgttcccaacctcgacaggttcgtgtttcagatggccggagctactgatgacgcacaaaaggattcaatttatgccagtgcgcttgtagaggctacgaaattctgtgcccctatatacgagtgcgcatgggtgagctccaccggtatcgtcaagaagggcctggaatggtttgagaaaaatgccgggacaattaagtcttgggacgaatcgtatactgagttgaaagtggatgttccaaagatcgagcagttagctaactaccagcaggcagccctgaaatggcggaaggacattggattccgcgtgaatgctaacaccgccgcgctatcaaataaggtcctcgcagaatataaagtgccgggcgagatcgtaatgagcgttaaggaaatgctgagtgatatgatacgacgtagaaaccaaatccttaataggggtggggacgagaacccccggggacctgtgtcccgcgaacacgtcgattggtgtagagagtttgtgaaaggcaagtacattatggccttcaatccaccctggggcgacatcaacaaatctgggaggagcggaattgctctggtggccacaggtttggcaaagctcgctgagaccgaaggcaaaggggtctttgatgaggccaagaagactgttgaagcgctgaacggatatctggacaaacataaggacgaggtggatcgggcctccgcagactcaatgatcacaaatctcttaaaacacatagctaaggcccaggaactgtacaaaaacagtagcgcccttcgcgctcagggcgcacagattgataccgccttctcttcctactattggttgtacaaggctggtgtaacgcctgagacttttccaaccgtgtcacaattcctgttcgagctagggaagcagccccgaggaacaaagaagatgaaaaaggcgctcctgagcactcctatgaaatggggcaagaaactttatgaactgtttgcagacgatagtttccagcagaatagaatctacatgcatccagccgtcttgaccgctggcaggatttctgagatgggggtgtgctttggaacaatcccggttgccaaccccgacgatgcagcccaaggttccggccacaccaaaagcatcctcaatctgcggacgaacactgaaacaaataacccttgtgctaagaccattgtgaaattattcgagatacagaagactgggtttaatatccaggacatggatattgtcgcctcggaacatctgctccaccaatctcttgtgggaaaacagtccccattccagaacgcatataatgtaaagggcaacgcgacatcagctaatatcatatga

SEQ ID NO: 6000 - RNA, 1449 nt, synthetic construct
  misc_feature 1..1449: note = derived and/or modified CDS sequence (opt3) from CCHFV(SPU 92/01)__KC880335.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggcctcagctactgatgacgcacaaaaggatagtatttatgccagcgcgcttgtagaggctacgaagttctgtgcccctatatacgagtgcgcatgggtgtcctctaccggaatcgtcaaaagaggtctggaatggtttgagaagaatgccggcacaattaaatcgtgggacgaatcatatactgagttgaaggtggatgttccaaaaatcgagcagttagctaactaccagcaggcagccctgaagtggaggaaggacattgggttccgggtgaatgctaacaccgccgcgctaagcaataaagtcctcgcagaatataaggtgccgggagagatcgtaatgagtgttaaagaaatgctgtccgatatgatacgccgacgtaaccaaatccttaatagaggcggtgacgagaaccccagggggcctgtgtctcgggaacacgtcgattggtgtcgcgagtttgtgaagggaaaatacattatggccttcaatccaccctggggcgacatcaacaagagcggcagatccgggattgctctggtggccacaggattggcaaaactcgctgagaccgaaggtaagggcgtctttgatgaggccaagaaaactgttgaagcgctgaacgggtatctggacaagcataaagacgaggtggatagggcctcagcagacagtatgatcacaaatctcttaaagcacatagctaaagcccaggaactgtacaagaacagctctgcccttcgggctcagggagcacagattgataccgccttctcctcatactattggttgtacaaggctggcgtaacgcctgagacttttccaaccgtgagccaattcctgttcgagctaggtaaacagccccgcgggacaaagaaaatgaagaaagcgctcctgagtactcctatgaagtggggaaagaaactttatgaactgtttgcagacgattctttccagcagaatcgaatctacatgcatccagccgtcttgaccgctggcagaatttccgagatgggcgtgtgctttgggacaatcccggttgccaaccccgacgatgcagcccaaggaagcggtcacaccaagtcgatcctcaatctgcagacgaacactgaaacaaataacccttgtgctaggaccattgtgaaattattcgagatacagaagactggctttaatatccaagacatggatattgtcgcctctgaacatctgctccaccagtcccttgtggggaaacagtcaccattccagaacgcatataatgtaaagggaaacgcgacaagtgttaatatcatatga

SEQ ID NO: 6001 - RNA, 1449 nt, synthetic construct
  misc_feature 1..1449: note = derived and/or modified CDS sequence (opt3) from CCHFV(SRR)__KU707901.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccggagctactgatgacgcacaaaaagattcaatttatgccagtgcgcttgtagaggctacgaagttctgtgcccctatatacgagtgcgcatgggtgagctccaccggtatcgtcaagaaaggcctggaatggtttgagaagaatgccgggacaattaaatcttgggacgaatcgtatactgagttgaaggtggaggttccaaaaatcgaacagttagctaactaccagcaggcagccctgaagtggaggaaggatattggattccgggtgaatgctaacaccgccgcgctatcacacaaagtcctcgcagagtataaggtgccgggcgaaatcgtaatgagcgttaaagagatgctgagtgacatgatacgccgacgtaatcttatcctgaacagaggtggggatgaaaatcccaggggacctgtgtcccgggagcatgtcgagtggtgtcgcgaatttgtgaagggcaaatacattatggccttcaacccaccctggggcgacatcaataagtctgggagaagcggaattgctttggtggccacaggtctcgcaaaactggctgagaccgaaggcaagggggtctttgatgaggccaagaaaactgttgaagcgctgaacggatatctcgacaagcacaaagatgaggtggacaaggcctccgcagacaacatgatcacaaatttactgaaacatatagctaaggcccaagagctttacaagaactcaagtgctttgagggcccagggcgcacagattgataccgccttcagctcttactattggctgtacaaagctggtgtaacgcctgaaacttttccaaccgtgtcccagttcctattcgagctcgggaagcaaccccggggaactaaaaagatgaaaaaggcgctgctttcaacacctatgcgctggggcaagaaactgtatgaattgtttgcagacgatagcttccagcagaatcgaatctacatgcacccagccgtcctcaccgctggcagaattagtgagatgggggtgtgctttggaacaatcccggttgccaaccccgacgatgcagcccagggttctggccataccaagtccatcctgaatttaaggacgaacactgaaacaaataacccttgtgctaaaaccattgtgaagctgttcgagatacagaaaactgggtttaatatccaagacatggatattgtcgccagcgagcacctccttcaccagtcgctggtgggaaagcaatctccattccagaacgcatataatgtaaagggcaacgcgacatccgctaatatcatatga

SEQ ID NO: 6002 - RNA, 1449 nt, synthetic construct
  misc_feature 1..1449: note = derived and/or modified CDS sequence (opt3) from CCHFV(STV/HU29223)__AF481802.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcacaattaagtcatgggacgaaaactatgccgagttgaaagtcgatgtgccaaagatcgagcagttagctaattaccagcaggcagccctgaagtggagaaaagacattgggttcagggttaacgctaatactgccgcgctaagcaacaaggtgctcgcagaatataaagtcccgggagagatcgtgatgagtgtaaaggaaatgctgtccgatatgatacggcgccgaaatcttatcctgaaccgtggcggtgacgagaatttgagagggcccgtttctagggaacacgtggagtggtgtcgggagtttgtcaaaggaaagtacattatggccttcaaccctccatggggcgatatcaacaaaagcggccgctccgggattgctctcgtggccaccggactggcaaagctggctgaaacagagggtaagggcgtgtttgacgaagccaaaaagaccgtcgaggcgctcaatgggtatttagataaacatagagacgaagttgacaaggcctcagcagatagtatgatcactaacctgcttaaacacatagctaaggcccaagagttgtacaagaatagctctgctctgagggcccagggagcacagattgacacacccttctcctcattttactggctatataaagccggcgtgacccctgagacgttcccaactatcagccagttcctctttgaactgggtaagcaaccccgggggaccaaaaagatgaaaaaggctctcctgagtacacctatgaagtggggcaaaaagttgtacgagcttttcgcggatgactcttttcagcagaaccgcatttatatgcatccagcagtactgactgccggacgaatctccgaaatgggcgtgtgcttcgggaccatcccggtcgctaatcccgatgacgccgcacagggaagcggtcacacaaaatcgattttaaacctgagaacctctacggagactaataacccttgtgccaagacaatagtgaaactctttgaaatccaaaagaccggcttcaatattcaggatatggacatcgttgcttccgagcatcttctgcaccagtcattggtggggaagcaaagtccatttcagaacgcctacaatgtcaaaggaaacgcaactagcgcgaatataatttga

SEQ ID NO: 6003 - RNA, 1449 nt, synthetic construct
  misc_feature 1..1449: note = derived and/or modified CDS sequence (opt3) from CCHFV(TAJ/HU8966)__AY049083.2__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctaactaccagcaggcagccctgaagtggaggaaggatattgggttccgggtgaatgctaacaccgccgcgctaagccacaaagtcctcgcagagtataaggtgccgggagaaatcgtaatgagtgttaaagagatgctgtccgacatgatacgccgacgtaatcttatcctgaacagaggcggtgatgaaaatcccagggggcctgtgtctcgggagcatgtcgagtggtgtcgcgaatttgtgaagggaaaatacattatggccttcaacccaccctggggcgacatcaataagagcggcagatccgggattgctttggtggccacaggactcgcaaaactggctgagaccgaaggtaagggcgtctttgatgaggccaagaaaactgttgaagcgctgaacgggtatctcgacaagcacaaagatgaggtggacaaggcctcagcagacaacatgatcacaaatttactgaaacatatagctaaggcccaagagctttacaagaacagtagcgctttgagggcccagggagcacagattgataccgccttctcttcctactattggctgtacaaagctggcgtaacgcctgaaacttttccaaccgtgtcacagttcctattcgagctcggtaagcaaccccgggggactaaaaagatgaaaaaggcgctgcttagcacacctatgaagtggggcaaaaagctgtatgaattgtttgcagacgatagtttccagcagaatcgcatctacatgcacccagccgtcctcaccgctggacgaatttctgagatgggcgtgtgctttgggacaatcccggttgccgaccccgatgacgcagcccagggatccggtcataccaaaagcatcctgaacttaagaacgaatactgaaacaaacaatccttgtgctaagaccattgtgaaactgttcgagatacaaaagactggctttaacatccaggatatggacattgtcgcctcggagcacctccttcaccagtctctggtggggaagcaatccccattccagaatgcatataacgtaaaaggaaatgcgacatcagctaacatcatatga

SEQ ID NO: 6004 - RNA, 1449 nt, synthetic construct
  misc_feature 1..1449: note = derived and/or modified CDS sequence (opt3) from CCHFV(TAJ/HU8975)__AY297692.2__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatatcgagttgaaggtggaggttccaaaaattgaacagttagctaactaccagcaggcagccctgaagtggaggaaggatatcgggttccgggtgaatgctaacactgccgcgctaagccacaaagtcctcgcagagtataaggtgccgggagaaatagtaatgagtgttaaagagatgctgtccgacatgatccgccgacgtaatcttattctgaacagaggcggtgatgaaaatcccagggggcctgtgtctcgggagcatgtcgagtggtgtcgcgaatttgtgaagggaaaatacatcatggccttcaacccaccctggggcgacattaataagagcggcagatccgggatcgctttggtggccaccggactcgcaaaactggctgagacagaaggtaagggcgtctttgatgaggccaagaaaaccgttgaagcgctgaacgggtatctcgacaagcacaaagatgaggtggacaaggcctcagcagacaacatgataactaatttactgaaacatattgctaaggcccaagagctttacaagaacagtagcgctttgagggcccagggagcacagatcgatacagccttctcttcctactattggctgtacaaagctggcgtaacccctgaaacgtttccaactgtgtcacagttcctattcgagctcggtaagcaaccccgggggaccaaaaagatgaaaaaggcgctgcttagcacacctatgaagtggggcaaaaagctgtatgaattgtttgcagacgatagtttccagcagaatcgcatttacatgcacccagccgtcctcactgctggacgaatctctgagatgggcgtgtgctttgggaccatcccggttgccaaccccgacgatgcagcccagggatccggtcatacaaaaagcattctgaatttaagaaccaacacggaaactaataacccttgtgctaagacaatagtgaaactgttcgagatccaaaagaccggctttaatattcaggacatggatatcgtcgcctcggagcacctccttcaccagtctctggtggggaagcaatccccattccagaacgcatataatgtaaaaggaaacgcgacttcagctaatataatttga

SEQ ID NO: 6005 - RNA, 1449 nt, synthetic construct
  misc_feature 1..1449: note = derived and/or modified CDS sequence (opt3) from CCHFV(TAJ/HU8978)__AY297691.2__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccggagctactgatgacgcacaaaaagattcaatttatgccagtgcgcttgtagaggctacgaagttctgtgcccctatatacgagtgcgcatgggtgagctccaccggtatcgtcaagaaaggcctggaatggtttgagaagaatgccgggacaattaaatcttgggacgaatcgtatactgagttgaaggtggaggttccaaaaatcgaacagttagctaactaccagcaggcagccctgaagtggaggaaggatattggattccgggtgaatgctaacaccgccgcgctatcacacaaagtcctcgcagagtataaggtgccgggcgaaatcgtaatgagcgttaaagagatgctgagtgacatgatacgccgacgtaatctttttctgaacagaggtggggatgaaaatcccaggggacctgtgtcccgggagcatgtcgagtggtgtcgcgagttcgtgaagggcaaatacatcatggcctttaacccaccctggggcgacattaataagtctgggagaagcggaatcgctttggtggccacaggtctcgcaaaactggctgaaaccgaaggcaagggggtcttcgatgaggccaagaggactgttgaagcgctgaacggatatctcgacaaacacaaggatgaggtggacaaagcctccgcagacaacatgattacaaatttactgaagcatatcgctaaagcccaagagctttacaagaactcaagtgctttgcgggcccagggcgcacagatagataccagcttttcttcctactattggctgtacaaggccggtcgcacgcctgaaactttcccaaccgtatcacagttcctatttgagctcgggaaacaaccccgaggaacaaagaaaatgaagaaagctctgcttagcactcctatgaagtggggcaagaaactgtatgaattgttcgcggacgatagttttcagcagaatagaatttacatgcacccagcagtgctcaccgccggcaggatctctgagatgggggtctgcttcggaacaattccggtggctaaccccgacgatgccgcacagggttccggccataccaagagcatcctgaatttacggacgaacactgaaacaaataacccttgtgccaaaaccatcgttaagctgtttgagattcagaaaactgggttcaatatacaagacatggatatcgtggcttcggagcacctccttcaccagtctctggtcggaaagcaatccccatttcagaacgcctataatgtgaagggcaacgcaacatcagcgaatattatctga

SEQ ID NO: 6006 - RNA, 1449 nt, synthetic construct
  misc_feature 1..1449: note = derived and/or modified CDS sequence (opt3) from CCHFV(Uzbek/TI10145)__AF481799.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctgattaccagcaggcagccctgaagtggaggaaggacattgggttccgggtgaacgctaataccgccgcgctaagccacaaagtcctcgcagagtataaggtgccgggagaaatcgtaatgagtgttaaagagatgctgtccgatatgatacgccgacgtaaccttatcctgaatagaggcggtgacgaaaaccccagggggcctgtgtctcgggagcatgtcgagtggtgtcgcgaatttgtgaagggaaaatacattatggccttcaatccaccctggggcgatatcaacaagagcggcagatccgggattgctttggtggccacaggactcgcaaaactggctgagaccgaaggtaagggcgtctttgacgaggccaagaaaactgttgaagcgctgaatgggtatctcgataagcacaaagacgaggtggacaaggcctcagcagataacatgatcacaaacttactgaaacatatagctaaggcccaagagctttacaagaatagtagcgctttgagggcccagggagcacagattgacaccgccttctcttcctactattggctgtacaaagctggcgtaacgcctgaaacttttccaaccgtgtcacagttcctattcgagctcggtaagcaaccccgggggactaaaaagatgaaaaaggcgctgcttagcacacctatgaagtggggcaaaaagctgtatgaattgtttgcagatgacagtttccagcagaaccgcatctacatgcacccagccgtcctcaccgctggacgaatttctgagatgggcgtgtgctttgggacaatcccggttgccaatcccgatgacgcagcccagggatccggtcataccaaaagcatcctgaacttaagaacgaatactgaaacaaacaatccttgtgctaagaccattgtgaaactgttcgagatacaaaagactggctttaacatccaggatatggacattgtcgcctcggagcacctccttcaccagtctctggtggggaagcaatccccattccagaatgcatataacgtaaaaggaaatgcgacatcagctaacatcatatga

SEQ ID NO: 6007 - RNA, 1449 nt, synthetic construct
  misc_feature 1..1449: note = derived and/or modified CDS sequence (opt3) from CCHFV(ROS/TI28044)__AY277672.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcacaattaagtcatgggacgaaaactatgccgagttgaaagtcgatgtgccaaagatcgagcagttagctaattaccagcaggcagccctgaagtggagaaaagacattgggttcagggttaacgctaatactgccgcgctaagcaacaaggtgctcgcagaatataaagtcccgggagagatcgtgatgagtgtaaaggaaatgctgtccgatatgatacggcgccgaaatcttatcctgaaccgtggcggtgacgagaatcccagagggcctgtttctagggaacacgtggagtggtgtcgggagtttgtcaaaggaaagtacattatggccttcaacccaccctggggcgatatcaacaaacctggccgcagcgggattgctttggtggccaccggactcgcaaagctggctgaaacagagggtaagggcgtgtttgacgaagccaaaaagaccgtcgaggcgctgaatgggtatctcgataaacatagagacgaagttgacaaggcctccgcagattcaatgatcgctaacttactgaaacacatagccaaggctcaagagctttacaagaatagtagcgccttgagggcacagggagcccagattgacactccattctcttccttttactggctgtataaagctggcgtgacacccgagaccttccctacgatctcacagttcctatttgaactcggtaagcaaccacgggggactaaaaagatgaaaaaggcgctgcttagcaccccgatgaagtggggcaaaaagctgtacgagttgttcgcagatgacagttttcagcagaaccgcatttatatgcatcccgccgtactcacagctggacgaatctctgaaatgggcgtgtgcttcgggactatccctgtcgccaatccagatgacgcagcccagggatccggtcacaccaaaagcattctgaacttaagaacatcgaccgagacgaataacccctgtgctaagactatagtgaaactgtttgaaatccaaaagacaggcttcaatattcaggatatggacatcgttgcctctgagcatctccttcaccagtccctggtggggaagcaatcaccttttcagaacgcatacaatgtcaaaggaaacgcgaccagtgctaatataatttga

SEQ ID NO: 6008 - RNA, 1449 nt, synthetic construct
  misc_feature 1..1449: note = derived and/or modified CDS sequence (opt3) from CCHFV(7001)__AF415236.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaggggtctggaatggtttgagaaaaatgccggcacaattaagtcgtgggacgaatcatatactgagttgaaagtggaggttccaaagatcgaacagttagctgattaccagcaggcagccctgaaatggcggaaggacattgggttccgcgtgaacgctaataccacagccctaagccacaaggtcctcgcggagtataaagtgccgggagaaatcgtaatgagtgttaaggagatgctgtccgatatgatacgacgtagaaaccttatcctgaataggggcggtgacgaatctccccgggggcctgtgagccgcgagcatgtcgagtggtgtagagaatttgtgaaaggaaagtacattatggcattcaacccaccctggggcgatatcaataaatccggcaggtcagggattgccttggtggctaccggactcgccaagctggcagagactgaaggtaaaggcgtctttgacgaggctaagaagacagttgaagccctgaacgggtatctcaataaacacaaggatgaggtggacaaagcgagtgccgacagcatgatcaccaacttactgaagcatatagcaaaagctcaagagctttacaagaactcttccgccttgcgggctcagggagcccagattgatacggcattctcaagctactattggctgtacaaggccggcgtaactcctgaaacctttccaacagtgagtcagttcctattcgagctcggtaaacaaccccgcgggactaagaaaatgaagaaagctctgctttctacccctctgaagtggggaaagaaattgtatgaactctttgcggacgattccttccagcagaatcgaatctacatgcacccagcagtcctgacagccggcagaattagcgagatgggcgtgtgctttgggaccatcccggttgctaaccccgacgatgccgcacagggatcgggtcatacgaagtctatcttaaatctgaggactaacacagaaaccaataacccttgtccaaaaactattgtgaaactcttcgagatacaaaagacaggctttaatatccaggacatggatattgtcgcctccgagcaccttctgcaccagtcattggtggggaagcaaagtcccttccagaacgcttataatgtaaagggaaacgccaccagcgcaaatatcatatga

SEQ ID NO: 6009 - RNA, 1449 nt, synthetic construct
  misc_feature 1..1449: note = derived and/or modified CDS sequence (opt3) from CCHFV(79121M18)__GU477494.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaggggtctggaatggtttgagaaaaatgccggcacaattaagtcgtgggacgaatcatatactgagttgaaagtggaggttccaaagatcgaacagttagctgattaccagcaggcagccctgaaatggcggaaggacattgggttccgcgtgaacgctaataccacagccctaagccacaaggtcctcgcggagtataaagtgccgggagaaatcgtaatgagtgttaaggagatgctgtccgatatgatacgacgtagaaaccttatcctgaataggggcggtgacgaatctccccgggggcctgtgagccgcgagcatgtcgagtggtgtagagaatttgtgaaaggaaagtacattatggcattcaacccaccctggggcgatatcaataaatccggcaggtcagggattgccttggtggctaccggactcgccaagctggcagagactgaaggtaaaggcgtctttgacgaggctaagaagacagttgaagccctgaacgggtatctcaataaacacaaggatgaggtggacaaagcgagtgccgacagcatgatcaccaacttactgaagcatatagcaaaagctcaagagctttacaagaactcttccgccttgcgggctcagggagcccagattgatacggcattctcaagctactattggctgtacaaggccggcgtaactcctgaaacctttccaacagtgagtcagttcctattcgagctcggtaaacaaccccgcgggactaagaaaatgaagaaagctctgctttctacccctctgaagtggggaaagaaattgtatgaactctttgcggacgattccttccagcagaatcgaatctacatgcacccagcagtcctgacagccggcagaattagcgagatgggcgtgtgctttgggaccatcccggttgctaaccccgacgatgccgcacagggatcgggtcatacgaagtctatcttaaatctgaggactaacacagaaaccaataacccttgtgccaaaactattgtgaaactcttcgagatacaaaagacaggctttaatatccaggacatggatattgtcgcttccgagcaccttctgcaccagtcattggtggggaagcaaagtccattccagaacgcctataatgtaaagggaaacgcaaccagcgcgaatatcatatga

SEQ ID NO: 6010 - RNA, 1449 nt, synthetic construct
  misc_feature 1..1449: note = derived and/or modified CDS sequence (opt3) from CCHFV(AP92)__DQ211638.1__N
  source 1..1449: mol_type = other RNA
atggagaacaagatcgaagtgaatagcaaagacgatctgaacaagtggttcgaggaatttaaaaagggcaatgggctcgtcgacaccttcacaaactcctactctttttgcgagaatgttcccaaccttgatagattcgtgtatcagatggcctcagctactgacgatgcacaaaaagacagtatttacgccagcgcgctggtagaagctacgaagtattgtgcccctatatacgagtgcgcatgggtgtcctctaccggaatcgtcaagaaaggtttggagtggtttgaaaagaatacatcgactattaaatcatgggatgagagctataccgaattaaaggtggacatcccaaaaattgagcagctgagttcctaccagcaggccgctctaaagtggaggaaggatatcggcttccggataaacgcaaatacaaccgccctctctaacaaagttctggctgagtataaggtgccgggggaaatccttgtccccgtgaaagagatgctgagcgacatgattcgccgacgtaatatcattttgaacagaggatccgatgaaaatcctaggggcccagtatcacacgagcatatcgaatggtgtcgggagtttataaagggtaaatacattatggccttcaatcccccttggggagacatcaacaagagtgggcgcagcggcattgcgctcgttgcaactggcctggccaaactggctgagacagaagggaagggagtgtttgaggaagccaagaaaaccgtcgaggcactcaaggattacttagacaaacacagagacgaagtggataagacgtctgctgacaacatggtgacttccctgcttaaacatatcgccaaggcgcaagagttgtataagaactcaagcgccctgagggcacagggtgctcagatcgataccccattcagttctttttactggctatataaagccggcgtcacacccgagactttccctaccgtttcccagtttctcttcgaactggggaagcaaccacggggaaccaaaaagatgaaaaaggctctcctgagcacaccgatgaagtggggcaaaaagttgtacgagcttttcgccgacgattcgtttcagcagaatcgcatttatatgcaccccgcagtgctgacggccggtcgaatatctgaaatgggggtatgcttcggaactatccctgtggctaacccagacgatgcggcacagggctccggccatacaaaatcaattttaaatctgagaaccaacactgagagtaataacccctgtgccaggacaatcgtcaagctctttgaaatacagaaaaccgggttcgacattaaggatatggacatcgtggctagcgagcaccttctgcaccaatccttggttggaaagcagtctccttttcaaaatgcctacaacgtgaaaggtaatgcaacgagcgccaacatcatttga

SEQ ID NO: 6011 - RNA, 1449 nt, synthetic construct
  misc_feature 1..1449: note = derived and/or modified CDS sequence (opt3) from CCHFV(ArD15786)__DQ211640.1__N
  source 1..1449: mol_type = other RNA
atggagaacaagatcgaagtgaataacaaagacgagctgaataagtggttcgaagagtttaaaaagggcaacgggctcgtcgataccttcacaaatagctactccttttgcgaaaacgttcccaatcttgacagattcgtgtttcagatggccggagctactgatgacgcacaaaaagattctatttatgcctcagcgctggtagaggctacgaagtactgtgcccctatatatgagtgcgcatgggtgagtagcaccggtatcgtcaagaggggcttggaatggttcgagaaaaacacagggactattaagtcctgggacgaatcttacaccgagttaaaagtggatgttccaaagatcgagcagctggccaattatcagcaggctgcactaaaatggcggaaggacattggatttcgcgtgaacgccaatacagctgccctctcgaacaaggtcctgtcagaatacaaagtgccgggcgagatcgtaatgagcgttaaggaaatgcttagtgatatgatacgacgtagaaatctgatcttgaacaggggtggggacgagaatccccggggacctgtgtccaaagaacacattgagtggtgtcgcgagttcgtcaagggcaaatatatcatggcgtttaacccaccctggggcgatgtgaacaagtctgggagaagcggaattgcactcgtggccaccggtctggctaaactggccgaaactgagggcaagggggtcttcgaagaggcaaagaaaacagttgaagctctcaaggagtacttagacaaacataaggatgaggtggacaaagcctccgcggactcaatggtaaccaatctgcttaagcacatcacgaaggcccaagaattgtacaaaaacagtagcgcactgagggctcagggagcccagatagatactcctttttcttccttctattggctatacaaggctggcgtgaccccagagacatttcccactgtctcacagttcctcttcgaactgggtaaacaacctcgggggaccaagaaaatgaagaaggcccttctgagcacaccaatgaaatggggaaagaaattgtatgagctctttgcagacgatagtttccagcagaatcgcatttacatgcatccggccgtgctgaccgctggccgaatctctgaaatgggcgtttgctttgggacgattcccgtggcgaaccctgacgatgcagcccagggatccggtcacactaagagcatcttaaatctgagaacaaactcggagaccaataacccatgtgctaaaactatcgtcaaactcttcgaggtgcaaaagacaggctttaatattcaggacatggatatagtagcctctgaacatcttctgcaccagtccttggttgggaagcaatcacccttccagaacgcatataatgtgaagggaaacgccaccagtgctaatatcatttga

SEQ ID NO: 6012 - RNA, 1449 nt, synthetic construct
  misc_feature 1..1449: note = derived and/or modified CDS sequence (opt3) from CCHFV(ArD39554)__DQ211641.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggcctcagctactgatgacgcacaaaaggatagtatttatgccagcgcgcttgtagaggctacgaagttctgtgcccctatatacgagtgcgcatgggtgtcctctaccggaatcgtcaaaagaggtctggaatggtttgagaagaatgccggcacaattaaatcgtgggacgaatcatatactgagttgaaggtggatgttccaaaaatcgagcagttagctaactaccagcaggcagccctgaagtggaggaaggacattgggttccgggtgaatgctaacaccgccgcgctaagcaataaagtcctcgcagaatataaggtgccgggagagatcgtaatgagtgttaaagaaatgctgtccgatatgatacgccgacgtaaccaaatccttaatagaggcggtgacgagaaccccagggggcctgtgtctcgggaacacgtcgattggtgtcgcgagtttgtgaagggaaaatacattatggccttcaatccaccctggggcgacatcaacaagagcggcagatccgggattgctctggtggccacaggattggcaaaactcgctgagaccgaaggtaagggcgtctttgatgaggccaagaaaactgttgaagcgctgaacgggtatctggacaagcataaagacgaggtggataaggcctcagcagacagtatgatcacaaatctcttaaaacacatagctaaggcccaggaactgtacaagaacagctctgctcttagggcccagggagcacagattgataccgccttctcctcatactattggttgtacaaagctggcgtaacgcctgagacttttccaaccgtgagccaattcctgttcgagctaggtaagcagccccgggggactaaaaagatgaaaaaggcgctcctgacaacccctatgaagtggggaaagaaactttatgaactgtttgcagacgatagtttccagcagaatcgcatctacatgcatccagccgtcttgacagctggccgaatttctgagatgggcgtgtgctttgggaccatcccggttgccaaccccgacgatgcagcccaaggatccggtcacacgaaaagcatcctcaatctgagaactaacacagaaaccaataacccttgtgctaggactattgtgaagttattcgagatacagaaaacaggctttaatatccaggacatggatattgtcgcctcggaacatctgctccaccaatctcttgtggggaagcagtccccattccagaacgcatataatgtaaagggaaacgcgacctcagctaatatcatatga

SEQ ID NO: 6013 - RNA, 1449 nt, synthetic construct
  misc_feature 1..1449: note = derived and/or modified CDS sequence (opt3) from CCHFV(BT958)__EF123122.1__N
  source 1..1449: mol_type = other RNA
atggagaacaagatcgaagtgaataacaaagacgagatgaatagatggttcgaagagtttaagaaagaaaacggcctggtcgataccttcacaaatagccactccttttgcgagtctgttcccaacctcgacaagttcgtgtttcagatggcctcagctactgatgacgcacaaaaagatagtatttacgccgcggctcttgtagaggccacgaagttctgtgcacctatatatgaatgcgcctgggtgagctccaccgggatcgtcaagaaaggactggagtggtttgaaaagaatgctggtacaattaaatcttgggacgagtcgtacactgagttgaaggtggaagttccaaaaatcgagcagttatcaaactatcagcaggcagccctgaagtggaggaaggatattggcttccgggtgaatgctaacaccgccacactaagccataaagtcctcgcggaatacaaggtgccgggggagatcgtaatgagtgttaaagaaatgctgtccgacatgatacgccgacgtaatcttatcctgaacagaggaggcgatgagaatcccaggggtcctgtgtctcgggagcacgtcgaatggtgtcgcgagtttgtgaaggggaaatatattatggcattcaacccaccctggggagacatcaataagagcggcagatccggcattgccttggtggctaccgggctcgccaaactggcagaagctgagggaaagggtgtctttgatgaagccaagaaaactgttgaggcgctgaacggctacctcgacaagcataaagatgaggtggacaagtcaagtgccgacagcatgatcacaaacttactgaaacacatagcaaaggctcaagaactttataggaactcttccgccttgcgggctcagggggcccagattgataccgcattctcaagctactactggctgtataaggccggagtaacgcctgagacttttccaaccgtgagtcagttcctattcgaactcggcaaacaaccccgcggtacaaagaaaatgaagaaagctctgctttctactcctatgaagtgggggaagaaactgtacgagttgtttgcggacgattccttccagcagaatcgaatctatatgcatccagcagtcctcaccgccggaagaattagcgaaatgggcgtgtgctttggcacaatcccggttgctaatcccgacgatgccgcactggggtcgggacacaccaagtctatcttaaacctgaggacgtccactgaggccaataacccttgtgctaaaacaattgtgaaactcttcgagatacagaagaagggttttgtcatcaaggacatggatattgtggcctcagaacaccttctgcatcaaagtttggtaggcaaacagagcccattccagaatgcatacaacgttaaggggaatgcgacctccgctaacatcatatga

SEQ ID NO: 6014 - RNA, 1449 nt, synthetic construct
  misc_feature 1..1449: note = derived and/or modified CDS sequence (opt3) from CCHFV(C-68031)__DQ211642.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgagagattcgtgtttcagatggcctcagctactgacgatgcacaaaaagacagtatttatgccagcgcgcttgtagaggctacgaagttctgtgcccctatatacgaatgcgcatgggtgtcctctaccggaatcgtcaagaaaggtctggagtggtttgaaaagaatgccggcacaattaaatcgtgggatgagtcatatatcgagttgaaggtggaagttccaaaaattgagcagttagctaactaccagcaggcagccctgaagtggaggaaggacatcgggttccgggtgaatgctaacactgccgcgctaagccacaaagtcctcgcagaatataaggtgccgggagagatagtaatgagtgttaaagaaatgctgtccgatatgatccgccgacgtaatcttattctgaacagaggcggtgacgagaatcccagggggcctgtgtctcgggagcatgtcgaatggtgtcgcgagtttgtgaagggaaaatacatcatggccttcaacccaccctggggcgatattaataagagcggcagatccgggatcgctttggtggccaccggactcgcaaaactggctgaaacagagggtaagggcgtctttgacgaagccaagaaaaccgttgaggcgctgaacgggtatctcgataagcacaaagacgaggtggataaggcctcagcagacaacatgataactaatttactgaaacatattgctaaggcccaagaactttacaagaacagtagcgctttgagggcccagggagcacagatcgacacagccttctcttcctactattggctgtacaaagctggcgtaacccctgagacgtttccaactgtgtcacagttcctattcgaactcggtaagcaaccccgggggaccaaaaagatgaaaaaggcgctgcttagcacacctatgaagtggggcaaaaagctgtatgagttgtttgcagatgacagtttccagcagaatcgcatttacatgcacccagccgtcctcactgctggacgaatctctgaaatgggcgtgtgctttgggaccatcccggttgccaaccccgatgacgcagcccagggatccggtcatacaaaaagcattctgaatttaagaaccaacacggagactaataacccttgtgctaagacaatagtgaaactgttcgagatccaaaagaccggctttaatattcaggatatggacatcgtcgcctcggaacacctccttcaccagtctctggtggggaagcaatccccattccagaacgcatataatgtaaaaggaaacgcgacttcagctaatataatttga
